United States Patent 7,745,391 (HUMAN THROMBOSPONDIN POLYPEPTIDE) - sequence listing, part 4

SEQ ID NO: 8558 - DNA, 371 bp, Homo sapiens
gttatgatgaccatagttttaataaaagcatccttaaacatcacgtagagtgactcccagttttgttctttatcaaagtattggctattctaggttttttgtttttctatataagttttagaatcagtttgtcaatttctacaaaaaatcctggtgatatttaaattgagattgcattgaatctctagttcagtttggggagaattgacatcttaataaaattgactcagtccatgaacatgatacaactttctatttatttaagtctttggtttctctcagtggacatcattttagatccctgctgtctgctttcccttccctctgccagccttacaaggcaggttcaggagtgtggctgaattgatgga

SEQ ID NO: 8559 - DNA, 622 bp, Homo sapiens
atatttctgaacaataatacaatgagacaatctaccagtgttggaggacgatttggctaacatcctgacttgagcttaatcctctatcagtgcttcccatcccttctactctcttactatccaaagtatatctcatcttcctcttttcccactgggatttactgtaaacccttttctcctccaccatgaaaaactctgccaaggagcttgctgtcattcccagctaccatctcatgccttccatttcttgtactgccagacttcacaattatgaccaattggtgtccttactatttctctatcatacattgtttttatttctctatcatatttaactgcgttatgacttgaaacttctcaatccattggatttactctttctaaagcctctaatggccttagttgccaaatccatgacatttcttcagccattatttattttgatggtagtcatatttgtaccgtgaactcataaagtgcagcgtgtctgatcccccttatttgccaggttccacattcttctcccccacacttccttcctgtgtgatctggtatagtcccaggttttactttctgagagtgtgactcccatattaacatgtttatttctggctttcttaag

SEQ ID NO: 8560 - DNA, 320 bp, Homo sapiens
gaaaagtttttatataaagtctaataatttaaattatatgggcatgtaaaattgccttatattacaacgccagccctacagcaggtagaaaattcctttcaacattctgttgtaaacagtttagattcaactgatcagtcacaggggaatatgggcagtttcaacctcttaccacctttgtctctaaaaagaaattctggatagttctttgtatacttatattaaagccatttctgttcattaaaaactcaatataagcatgttgaagaaggggcaatggaacatgaagcaatgaataaaaagattctgtgcatgtataa

SEQ ID NO: 8561 - DNA, 410 bp, Homo sapiens
gattttccaaagttagtgtttgtcaagcacataattccatccctagtactgttctagatgctgtatgtacattatttctaatcctcctgtagtctctgggaagtaggtattactgagctcattttgcccatgagaaactgagtctgagaaaggttaaatatctagtccgcgtaaccatttatgtatttgtactggttaaacataatcatttatgcatttgtacaaccagtgagtgccttccaagattccaacccaactttgagggaatcccccaaagcatccaccacacaggggccctgtgggcttccaaatctttgctttccatggaactttgaatactcaggcacatttgcatgggctcttgcttctgtttggaatgccctcattcccttgcccgtctcacaggtgca

SEQ ID NO: 8562 - DNA, 595 bp, Homo sapiens
ccttctgctaaaaatacaaaattagctgggtgtggtggtacatgcctgttatcccagatactcaggaggctgaggcaggagaatcacttgaacccgggtggcagaggttgcagtgagccgagattgtgccactacgttccagcctgggtgacaaagcaagactccatctcaaaagaaaagaaaagaaaaagctagtgctcacaatgacttacaagactctaccacgtcatgtctccagttacatctcttaacccctcttcttgagaagagtggacccctcacatatgcttctatgttaggagatttacattggcagttctttctgctagcagggtctttcctggagatccaccttccttagtttctcatatatgaagtctgttcaagtatcactttgtcagtgaagcctgctgtgccccctactttatttaaaattgcaatcccccgccctcccttactgcacatttctggtctcttatcctctcctattttttttttccatagaatttatgacctattttattacatactctttattttgctcattgcctgtctccctctacccctacacttgaataaaagctgttatgtaaga

SEQ ID NO: 8563 - DNA, 741 bp, Homo sapiens
gtctgtaaaaaagaaaaagataaggtctgtcacccaggctggagtatagtggtatggtcatagctcactgcagcctgaaacttctaggcttaagcagtcctcctcctcagcttcctgagtggctgggactacaggtgcatgccattgcacccagctgtttaattttttgtagagatggggtctcagtatgttgcccaggctggtcttgacctccttggcttcaagcagtcctctgccttggcctcccaaaagtgctgggattacaaggatgtgccaagcctcaaatttctatctcatatcagacttctctcccagtctctcatattgaactgtctacttgacacctccacttagttatctggcatttcaaaatcagtatatctgaaactaaattcctgctaaccccttcaccagaaagaaaacatacacaaatcctacaaccttagcctttgccaaccatctcatttaatgacaattccatctttccagttgttgagactaaaacccaggagtcatccttgattcctttctttctgcagtaccctacttccgatctatcaggaagttatatttgctctgttttcataacttatccagaatcagtccacttcttacgaattccactaatttgactataatgcaagccacattatctcttgcctagattatattaatagacccctaacctgtttacgtgtttcctcccctctacaataaagtttctcaatacaattgccagaa

SEQ ID NO: 8564 - DNA, 832 bp, Homo sapiens
tagttttgtcattaaaattaacaaaaatattaactttgattacaggcgtgagccaccgcgcctggcccgcccctacatttcagaagcagcaacagggcatggaattcttctcatgctttgactctctcctgagattagattgggcctacccagatacttcagaataatctcatctccagatccttaaccttaattacatctgcataattccttttgtcaccttaaggtaacatattcacaggttccaggaaattagggaatggacatgtttggggaggcgattggtttgccaaccataatgaaggacataaacaaaaaaccaacttaaatggcacatttaaaacttgttgtgataccctaccttgtttaaacctgagtgactctctcctagcagacagagccggacagactccattttagtttctttgcttgcagccctctttatccccctaagggagtaactagtgcaagctgactccaagcacatccaggaattcacctgctgataagatattgaggcaagctgtaccagcagctcctgggaatgtgctcggtggaaggtacctaaagcccccgcatttatctcttagtgatagtttaagcccctgtacctggaactgtttattttttgtaactgcttctataaccaattaacttttttaactttttgcctattctgcttctgtaaaactgcttcagttaaacccccctcccctatttagaccttagtataaaagaaaatctagccccttcttcagggccgagagaattttgagcgctagctgtctcccggttgccggctaataaaggactccacaatttgtctccaagt

SEQ ID NO: 8565 - DNA, 470 bp, Homo sapiens
ccctaaatagcagcagtagattccataggaaatttgatattgcctgtgtaaggagtgacagacatttgctaccctgaataagataatttttatagaaaattgtttttcctagagtgaaagatcaatttttatatgaacaccaactaaaaatatagttgagttggccaattaaaatgtcttttgaggctgggagtggtggctcacacctcccagcactttggaaggcgaaggtgggcagatcacggggtcaggagatcgagaccatcctggctaacacagtgaaaccccgtctctactaaaaaaaaaaaaaaaaaaaaaaaattagccgggcgaggtggtgggcgcctgtagtcccagctactcgggaggctgaggcagtagaatggtgtgaacccgggaggcagagcttgcaatgagccgagatcacgccactgcactccagcctgggcgacagagcgagactccatctc

SEQ ID NO: 8566 - DNA, 489 bp, Homo sapiens
aatgagaaatctttgatggaattagccatgcagaacagatattaaatgcatcctcattcttctcatagtcaaaagtatttgcctaagctggatgggaaaaagagaatcccatttcactaagtataaaagaggggattttagagaaggtctcagaagaaagagatgtggcggtttggtgaaactcaccagaggctgaaccctctccagcataacacacggattgggaggagtggggtggcattaggccaggtgcgtagcccagtgctgctctctctggacttgtttgctagctgaactcatccatttgcataattttcagtgccatttctcagctgatgagtcctgaacttttgtcttgaggttagacttctccttcaaacagcagtcttaaacactcaacttctttcttgttttttccacttgtcaactcatgaacacctcaaccttgttaaatccaaagccaaactcatggcttggagtggtaggtga

SEQ ID NO: 8567 - DNA, 267 bp, Homo sapiens
gcttgtaggtacagagattgcatgtgtaatcaaaacctgctggacagaaatggtcctgagcgtctctgggtgtttggcctctgtttcatttcttattaaatgggggagatacagcaggattataaagactgcaggcaatgtctgtaaaatgcaaacatgccaggtttttggtaaatagtagctgttgcccttttctctaaatcagttaataagataaataaaagattttgccttatatagttcctcattcccctcctggccaccctc

SEQ ID NO: 8568 - DNA, 311 bp, Homo sapiens
caattataattgagactatctctactaaggtctaatatctctaatagaaataaggtcatgcctaaagaggttagaagatgcaaattcagtagccatactgttaacataattgctctaattctgtatccatgttttattaaagcattgtttttgtcaaaaaagaaaagcaagaaaagttgtctagttctagttttcagaaaggagaaagtgaaagcataacttgaattaaaattctaatgttggctactaaatagggaatatagaataatgtactggacagtttctttgtaaaatgcagacgcatgcttcag

SEQ ID NO: 8569 - DNA, 578 bp, Homo sapiens
tgtgagtgtttgacagccaggtcttggaaaggaaggccaacatgccctgggctgatcagactccatcatgttgactcctgggaggcacatttttgagaaacaattaggaaccaggaagcattctgaggaggaaagccaggataaagaagactcagataaaaaagtcatcccaccaggtctggatgcagtgtgactgtatcagtcagcttttgctgggttatgccaagtaacaaacaggattcaggctgaaagatcagctatgaaactgctggttttgaggcacaggaaaaagagtgatggcagaactgagaaatgactttaaagcctctgctcagaagtggcttatatccctctgttcacattttattggccacagagaatcacatgatcaaatatgtcttcagacttgatgggcttagggagataccatgctcccacagggaggggtggtaactatttggccagcacagagtagataccaacagttattaaactgtttgttgaatgaatgaatagatgaattctctgatcctggaaggatttaaataaagaatggatgaccatttgtattacctatc

SEQ ID NO: 8570 - DNA, 687 bp, Homo sapiens
tgtgagtgtttgacagccaggtcttggaaaggaaggccaacatgccctgggctgatcagactccatcatgttgactcctgggaggcacatttttgagaaacaattaggaaccaggaagcattctgaggaggaaagccaggataaagaagactcagataaaaaagtcatcccaccaggtctggatgcagtgtgactgtatcagtcagcttttgctgggttatgccaagtaacaaacaggtaccaaactcagtggcttataataattataataaaaagggttgttcttattaatgttgcacattgcctgcagtaggtgtgagcctgttctatgtttttttcattctaggattcaggctgaaagatcagctatgaaactgctggttttgaggcacaggaaaaagagtgatggcagaactgagaaatgactttaaagcctctgctcagaagtggcttatatccctctgttcacattttattggccacagagaatcacatgatcaaatatgtcttcagacttgatgggcttagggagataccatgctcccacagggaggggtggtaactatttggccagcacagagtagataccaacagttattaaactgtttgttgaatgaatgaatagatgaattctctgatcctggaaggatttaaataaagaatggatgaccatttgtattacctatc

SEQ ID NO: 8571 - DNA, 439 bp, Homo sapiens
gccacagtgaacatggacggaaaggagaccacagcacccgggcgtggcatggacagctttggagggcagccttgcactcagcagctgcccactccccatgcggagaaaatatgtccatgagcccgaggtgttttcagcaccatgtgcttaggccaaccctagtcttgattgacagtatcacataatcctagcatgtcagagctggaactatccaataagcacactgtgcagaaggggaaactgaggccatgacagtgacatgccccaagtcatagagtaagtggcagcaaatccagaacccgaatccgggggtctccaatcaggaaccttttgcatcccactttgctgttaactcagtcaccagcccatgcaatgtgggactagggctgctacacccccacccctatttcatcgaataaacacatcagtgcttactata

SEQ ID NO: 8572 - DNA, 389 bp, Homo sapiens
tgcgattaaaaaaaatgagaacaaaattctcactggctcattctatcccacctaacacctttcaggatcagcatagagtctcttgaacagcatgggtctgaaccactcagtccacttacatgcaggttttttcttttttaacagaagttacactgagtgtgcctgcctctccttccccctcttccacatccaccacctatgagacagcaagaccagcccctccccctcctcctcagtctactcaacttgaagatggcgaggctgaagacatttacgatgatccacttccccttagtgaacggcaaatatattttctccttcttaagattcttaataacagtcttttctctagcttactttattgtaggaaaatggtatataatacacat

SEQ ID NO: 8573 - DNA, 990 bp, Homo sapiens
cactcttaatgggagagctataaaaggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctgtgaaaatatcatggaataatagggattttagggtggatactttattttcttttatatttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaacacaggccaagtcccctccccaacctaattaggtcattcaggacagctaagtcagtatatttagagcaatactagcatacgtttttcttaattgtaatcagcattgaccaagtggtttggaaggaggcatgctttaatatcacaataattttgatttgtaaccagaaattaatcctgtgttatctaacttcataatagcaatattgccgaaagtaagggtattacaacaggtctttaagggggccggttacccttcacatactggtgtgtccaagttttttccc

SEQ ID NO: 8574 - DNA, 756 bp, Homo sapiens
  misc_feature (738)..(738): n is a, c, g, or t
  misc_feature (743)..(743): n is a, c, g, or t
  misc_feature (752)..(752): n is a, c, g, or t
cactcttaatgggagagctataaaaggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctgtgaaaatatcatggaataatagggattttagggtggatactttattttcttttatatttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaacacaggcccaagatgaggggatcctctagagngacancaggcagcnaagc

SEQ ID NO: 8575 - DNA, 851 bp, Homo sapiens
cactcttaatgggagagctataaaaggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctgtgaaaatatcatggaataatagggattttagggtggatactttattttcttttatatttctatatgttgcgttgtgatgacattatcttttaaattaaaaagagatttggctaaaaaaaaaaaaaaaaaaaaaaaaaaaaaaaaaggggggggggaaaaataacctcccgggaggggggcacaaagtttatgcggcgacacccagtcttctttgtggtcaaacagagggggggccccataagagaggaggcgcgttaattaaaacagcaagaggagcagaggggcgcggctgttaaaacaaaaggctcggcgcgggcgggaaaacccggctctcgcggggcataccctggggagaaaggaacccctcattcgcggggggggggacacacaacggcgcgagcagcactgcccaaagaagaataaaaagagtcccacggacacataccaaacatccgcagcgctcttcacgggcgacacacacgaggccactaaagacggcggtctgaacaatcgcgcaccgactctgtttccgaacaatacttcgagg

SEQ ID NO: 8576 - DNA, 650 bp, Homo sapiens
cctgggcaacagtgagactccgtctcaaaataaaaaaacaaaaaaaatgtaaaaaataaataattgtattgaatttattagttgtgtctcagtctccttcagtctacagtttaggcttgcttttgcacctttgcattttaaggtaagaggctattgtgtaaactcgaattgggtttgttggtgtttcttcatgatttggttcaggctctgcattttgggcaggaatattcagaggtgatgctgtgttcctcccataggatcgtatcaggcgacacatgattatgaatttccccattattggtgatgtcacttagttgtgttgtctgccaggttctgccactgtaaagttaataagtattttgtagggaagtgctttgagactaaatatcctgttcctcatcaaacttctaccccctagtttcagtatctattgctgttttttgtctgaataactatgatagttgccaaatagtggtttctgatccttccattccttctacactgattggttggtattttgtacagaaaagctttctcatatctgatttacttgtctcaatatggacccatgggtatttgagtttcttgtggggttatttgttgttgtttttgagacagcctgggcaacaagagtgaaatccgtctcaaaa

SEQ ID NO: 8577 - DNA, 1371 bp, Homo sapiens
cctgggcaacagtgagactccgtctcaaaataaaaaaacaaaaaaaatgtaaaaaataaataattgtattgaatttattagttgtgtctcagtctccttcagtctacagtttaggcttgcttttgcacctttgcattttaaggtaagaggctattgtgtaaactcgaattgggtttgttggtgtttcttcatgatttggttcaggctctgcattttgggcaggaatattcagaggtgatgctgtgttcctcccataggatcgtatcaggcgacacatgattatgaatttccccattattggtgatgtcacttagttgtgttgtctgccaggttctgccactgtaaagttaataagtattttgtagggaagtgctttgagactaaatatcctgttcctcatcaaacttctaccccctagtttcagtatctattgctgttttttgtctgaataactatgatagttgccaaatagtggtttctgatccttccattccttctacactgattggttggtattttgtacagaaaagctttctcatatctgatttacttgtctcaatatggacccatgggtatttgagtttcttgtggggttatttgttgttgtttttgagacaggctcacccaggctggagtgcagcagcacgatcactgcttactgcttactgcagcctcgacctcccatgctcaagtgattctcccaccccggcctcccgagtggatgggactacaggcatgtgccaccaagcctaatttttgtattttttgtagagacagggtttcaccatgtgtcccaggctggtcttgagctcctgagctcaagcaatcctcccacctcggcctcccaaagtgctgggatgagccaccgcgactggccccacttaatgggttttcagaggtgggagcaaagaatgaagggaggaagagagctcccatcttttccattaccgtatttacttaaaactggaaaaaactgaaccactgggatggcatttcatttatcttttgaaatgaagaatagatacattaatttaaatgattctctaaagactgtccttcagcatccctaaagcattgcaaaactataggcacagtttttattttatctttctggcacctggtttgggctttggcttagattaaaaagacgagccttctcctgcccctgctcccttttattccctgccatctgctaagctcgactttttatctctcaggccaaatttgactctgtaagggactttgcataacgtttcatcctcagaatcgctaatgatgggcagaggactgttacatgtgttgggagggattaaagtatatgacctcagtgccacttaaaaaataaatactgtctcaactatcagtctggct

SEQ ID NO: 8578 - DNA, 1038 bp, Homo sapiens
tggataatcaagagagtctcagcctttaggtagctgacactgtgataagagcatcctgtgaactacccaaataaggaggaaaacgaacgcagctgagcatgggatgccatataaaaatcacttaaaccagtcgccactccttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctaggaaatcagtgtggcttacaccagtttctactgagaatgaaataaaattggatcctagtccttttattgctgactttcagacaacagcagaagagttaggattattatcttctagtccaaacttgctctgagctaaaggagaaatggaaacttgaagctggtgttatgtattttgcaggaaaacagtttcattttttcatagcaaaaatatagttggtgtatatctctccttaagtctctggtttctaaaaaccctacttcagtaaaggtcctgattagttgattagtgaatgtgtatttctaaatatttgtattcagtaggggtatggctgattaatttaacattaactattaggtaattcatattatacatttaagttctttctgttctgtgtagaagattcagaaatatgtcttcaaagacaatgacttgatctaattgataagaacctccaataaatatgttctaatatttttcaggaagaataaagaatagagagag

SEQ ID NO: 8579 - DNA, 521 bp, Homo sapiens
tggataatcaagagagtctcagcctttaggtagctgacactgtgataagagcatcctgtgaactacccaaataaggaggaaaacgaacgcagctgagcatgggatgccatataaaaatcacttaaaccagtcgccactccttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtaagaacagtgattgtttgtaaaaaatactgcatgttttgtcagacttttatgcctagtattaaaattgtcttttaaaaaaataatg

SEQ ID NO: 8580 - DNA, 715 bp, Homo sapiens
tggataatcaagagagtctcagcctttaggtagctgacactgtgataagagcatcctgtgaactacccaaataaggaggaaaacgaacgcagctgagcatgggatgccatataaaaatcacttaaaccagtcgccactccttgtttcctgagttgtcctgtgctggaggtctgctcagacgaaggtctccatggcgttagaagtcttgatgctcctcgctgtcttgatttggaccggtgctgagaacctccatgtgaaaataagttgctctctggactggttgatggtctcagttatcccagttgcagaaagcagaaatctgtatatatttgcggatgaattacatctgggaatgggctgccctgcaaatcggatacatacatatgtatatgagtttatatatcttgttcgtgattgtggcatcaggacaagggtagtttctgaggaaactctcctttttcaaaccgagctgtactttaccccaaggaatatagatcatgaccctcaggaaatccatttggagtgttccacctctagtgtttgatgcagaaatcatggggagactatctggaattagttcttctgtaagcctatctgctcaaatcctgtaccaagagtccacgaggatctagaaggcgtagtatgctggctctatgccatactcctgaatgactattctgtatatgatcatgatattaaacagtggtaaaactga

SEQ ID NO: 8581 - DNA, 335 bp, Homo sapiens
gcagcctcaacctcttgggttcaagtgatcctcccgcctcagcctcccatgtagctgggaccacaggcacatgccactacacccagctaatttttttatttttttgtagagatggggtctcactctgttgcccaggctggtggggatggtttttattattaaattactaggctgataaccaatagtcattatgaaaacataattcctcaaaactcttaggagcagcataattcgttagggtttaccattttgttatgccctaatttgtagagactcttaaacagatatcttatgtctgatccatactggcaaccagccagttgtccctggttttg

SEQ ID NO: 8582 - DNA, 334 bp, Homo sapiens
tttcagtaactactaggttgggacctacgctatcttttagggggagacattaaggatttagttaaggctccacagctgatgacagcagcgtttctccatccttcgagaaggccacccaaactgaggttgtactttctcagtagcggccacttggggcactagagctgcctcagtgaagtacgcaagggagcagcgggggtaccatcgaagctccacttcactgtgatcaagacagcagtggggtaccattgaggatcaaccctagggaccctgaaacagggtggcaacctccttatgttcctcaattggccttcccatcttttttttttttttg

SEQ ID NO: 8583 - DNA, 413 bp, Homo sapiens
acccacaacagtgaagtcctgctcaaaatgtcaatagtgtcaaggttgagaactcttgtcctagatgaggaaccttgtgggaattaactactcttactaagtacattatttttctcttgctgctataacaaataatcccaaacttggtggcttaaaacaatgcaaattttttcttttacatttatggaggccggaaatctgaaatcaggttcatttggttaaaatcaaggtgttggtagggctggttctttctgcagggtgtaggggagaatttgtttcattgcagctctagacctcttccagcttctagaggtcacctgcatcatggctctttcctgcatcgttttatcctctgcttccgtcatcacatctcctactgtgtttttgactcctagtgtgtgttttgtttcccc

SEQ ID NO: 8584 - DNA, 412 bp, Homo sapiens
agtttggtgttggaaagctgctttgtcatgtcatccttcagatttgagcatctctgctgctatacaactttttaaattcaagaaaaagaaaaataatattttaataattaagaaagcacattacatcataacatgttgaatgatactgtacaaatacatttaaaacatgattgcaatataacgtcaataagacattcaatgctttagtggcatacttatcatgtgcatttcctaatctaatgtcacatgcctgatttagagaagagtcatgaaaagcatgctgggccagtcttatcttctaaaacaaagtggcgatttgtccaaaatcagcgtaaccaatataccaattgaatttatatttctgcattgctgaaactctgaaaaatgaaagctttgaaaaacctcggaaaaa

SEQ ID NO: 8585 - DNA, 821 bp, Homo sapiens
ttatggccgggcgccatggctcactcttgtaatcccagcactctgggaggtgggtggagcacttgaggccaggagttcgagaccaacctgggtaatatggagaaaccttgcttctactaaaaataacaaaaaaaattagctgggcgtggtgacacctgtccgtaatcccagctacatgagagactgaggcatgataaccatttcaaccagggaggcagaagttgcggtgagccaagatcctgccactgtactccaacctaggcaacaaagtgagacttttatctagttgttctgcagtctcagtggcagtggcttttctccttttgtgaatatcaacaacaaactacagagttgactcacaggatgtaaaaaattggggtgacatgcatgggagactgtgttgatactaatatttgcatgactgattgagaaagtttgtcagaaacattgtcactagtactattgtaggaactacgctatgagtggggtgaagtcttgccctagcattagtataaatccttagcctgctgggcatagtcttaagaaacaacccattcagggtcgggtgtggtggcctgtaatctcagcactttgggaggtgggtggattgcttgaagtcaggagctcgagaccagcctggccaacatgacgagaccccgtttctacaaaaaatgcaaaaatcagctgggcgtggtggtacacacctgtaatcccagatacatgggaggccaaggcatgagaattgcttgaactggggaggcgaaggttgcagtgagccgagatcatgccactgcactaggtgacagcaagactgtgtctca

SEQ ID NO: 8586 - DNA, 598 bp, Homo sapiens
gcacgagtcttaaatcagatattcctaatgctattaatacttcctctaagcacgttggttttggggaggtgttatcccagttttacacataagtctgatgccagggaatggtgttaaagaaagtgagtaactgattaagtagaatatctgtgaagagagagcactgccattgaatattactggcttttccactctctgtcagctttagccttcaactcgttaggcttcttcaaacttaccttatataggtacatagaagtctcataaaaggtatggtctaaagcttttgtagcaaaagtttgatttttaatacttgcattgaatatggctgtgtctaattggggaaccaaatagtaagatcaatttcagagattactcaaaaagctaccatgcccctgcgctccttttttctcccctctgaacaatagtataaagtgagttgtgttgctctgtttttatgaaagtggggtgggatgtcaaattaagtggttcctaatgttagaatcagaattgtgggaagagagaagaggcagttgttcaaatatgaaacataaaagtgctgcagaggtacatgcagagtgtgtcagtagatggtaaa

SEQ ID NO: 8587 - DNA, 416 bp, Homo sapiens
cccccacactggaatcttctctgctttttttgttttgttttgttttagatatgtctgagtcttctgattctccatcttttaaaatgagaactaggtctttaaccttcagggcaggaggaaaaaagcccaaagcaaaatctgagacacatgaaccacagaatgcaaaaacaggagagggtttttcaaattggctgcacagaaatcaaacagacgtaggagtgaggtgaaaagaaggccaagacaaagaagcactgggtggcctatggatgccgcacatggggccacccttagagcagcagagcccaaggcctgagagcaccgactgcggggctcaggctggtctggccaagtgcctgctgacacagatggaagattctccaccaaagcccagttctaatgaccagcacacatgctac

SEQ ID NO: 8588 - DNA, 467 bp, Homo sapiens
aatgctacttactgtataattctacttacacaacgtttttgaaaaggcaaaactatagtgatagattagtagttactaggtgccacaggtagaaaaaaagtatttgctggcaaggtggcgaggaattttgggggtaatagaaatactctatatcatttttgtgatgcttacacaactgtccatctttgtcagaaatcatctatcctcccaacttatgaattttattctatataaattatatgtctataaagatgattttaaaaaacaatttatttttgcttttcagggtcagtgccaggggttgttcagcctacgtttagtaccactattcatctattatattcctgtcagcttgagagatacagtcagggagcacctaaaatcccgcagtgtttcagcacaaatacccggggcaagcctgggctagttttgttctactgctttctcagcaaaccataataggaggt

SEQ ID NO: 8589 - DNA, 762 bp, Homo sapiens
gtcttttgttctactactagccgacatagaaagcacctgtcatgtgccagtgtcaaatactgcgctaggaactgggaactcaaggcacaggagcctggcttttgcgcagggcgctcacaggccggtgggtgcaaaccctgaaggacacacagcctgtccctttagcgcccatcgcttctggtgtgagctcccgctaagggtgggtgagtactggggtgggcttccagaagaggcctcctttgagccgaatctgcagagaccaagtgtctatgagaactgctcaagagtgctttgcacattctcctccacaaaggtcgaggctcccactgcgcccaggaatgcgcctcgtcagacattaggcgccccttgattttgtgtttgcatctcacgcggtcctctagctgacaagtgcatcagaagagtcacagtggctgtcacaagccagagactcgcagaggacaggaacgcgggaaatctaggcaattacctccagcatataccaagagctattgcgaggatcagatccctttaaaaatggtgacgagacaggagagggcggctcctctagagctttccggaacgtctttacctctgtgtcctttataccttttatctcccccaaacaaggtccttagtcagtttctctttctatttccccatcttcctcccccacctccctgtgtagttctagggggaaaaaatgtgttgttttcctttttttctgatgcttctaatattaaatgcgtctattttcccactctc

SEQ ID NO: 8590 - DNA, 451 bp, Homo sapiens
ctccgtcatctgttcctgccttacttagatggaaaataatgaaatctgtgtaggaagggaggaaattctctgaagaggacactttacctggctggacaggaagcacggcagcatctactcggcttctgaggcgtcctcaggaaacctacaatcaaggtggaaggcgacaggggaagcagacatgttttatgtggctggaggaagaggaagagaagtggggggaggtgccacacacttaaacaaccaggtctcttgagaactccatcacaacagcaccacgaggatggtgctaaaccattcatgaaggatccaccaccacagtccagtcaccttccaccaggctccacctccaacactgggggttacaatttgaaatgagatttggtagggacacagaaccaaaccatatcagacagttcttaaaaatctttttcaatttaacatttaaacc

SEQ ID NO: 8591 - DNA, 527 bp, Homo sapiens
tttctttctttttttccccagctacagtgtaattgcctacctgcctgggccccttctagaggaaggtgggctttccttgtccgtcaggctgcactcatgaggtgatatcgtaaagcagcagaaagactgagggtgcaaagaaaccacagctgccattcacggggcagctccctctagctcttctgcccagtgaccttacaggctttagaggagcctgatgagagctatcctgggggccaagggatgcattccctgcagcttcctcctgggggacccacaggtcagcccattccaggagaagcagtcttaggcccgtttgcatcccctgccactgccatgtgcctgccagcccggtttctgatgaagacgtggctcagtccctgctctccttgtcgcagtggcttgtacttcatgtgcagtagcccagggcccgccttctagagtgaatgtttccctcgagcccttggatatttttattctattttgaatggttccgatcaattaatgttgctttgtgtggggttctt

SEQ ID NO: 8592 - DNA, 328 bp, Homo sapiens
ctgagacaaatttcaggaaagaatacttactatgcaaagtgaattctggtgtttcctacttgttaacagtttttaatattggatgaaaccacttaatcgatttcacttccaataatttgaaatacactgacttaaaagctttgccatagggcacaatcgccttttaatactaagaaagtaagggagatgtgttccaaggggcaaaagaaataatgcatttttggccaggtgcggtggctcacgcctgtaatcccagcactttgggaggccgaggcgggcagatcacctgaggtcgggagtttgagaccagcctggccaacatggagaa

SEQ ID NO: 8593 - DNA, 514 bp, Homo sapiens
cacgcctggcccttgctcctggatttttggcttggaatagccttgtcccatctctgtgataaaatcccagttgttctttgagtgcccacccgtggagaccctcttcataaagctgctcttaaaccctgtcccttttccccatccccagttccacacacctgggagcacctctaatcacctctgctagaagtcgtctcccccagaacatttggattctctctcttggctttttatcatagttcaccttcttttctgtttatatgaatacttgtcttatttcttctaggaacctgtaaaatcctagaagacaaggaacctgtctttttcctttctctttcattccccctcttccctctcttccaccctactccctcttcctttccctctcccttcagtatcatgaacctcggagccccaccctagaactcctgaatcagacactttgagggtggctgggcgcaatggctcacggctgtaatcccagcacttggtgaggccgaggcgggtggatcac

SEQ ID NO: 8594 - DNA, 372 bp, Homo sapiens
ggtgccacatgtctaactcatctcctactgttagcagaggtttctggcaaagctaaaaattatgattaaacaggccaggcatggtggctcatgtctgtaatccctgcactttgggaggctgaggcgagtggatcacctgaggtcaggagttcgagaccaacctggtgaaacctggtgaaaccccgtctctactaaaaatacaaaaattagctgggtgtggtggcgggcacctgtgatcccagctactcaggaggctgaggcaggagaatcacttaaacccgggaggcagaggttgcagtgaactgagatcgcaccactgttctgcaggctgggagacagaaggagactctgtctgaaaaaaaaaaaaaaaaa

SEQ ID NO: 8595 - DNA, 486 bp, Homo sapiens
ggttttgctccagacttaaggtgcacggaaaccggagcattcagcccttcatggatgcctcccgaaaacctcaccatgccagtgacacgactgcaaacggcgggtggcacatgccgggggcttgggatgggagggtttggaaacctcgctccaaggacgccctcagccaaggagcttcggctccttcctagaatttctagaagcacttttggagggaccgagggcttccggccgggcccagaggaatttgagcgcttgcccgggcaggcagaagcgcagcctggggagtggagaggctgctgggccacattccggcccagcttcccccgctaggccccagccctgccgcggcgccccaggaagcacctccgaaaacaaagcgctgtggtttcagcccaaggttaaagtccaccgcgagcgtgttttttcccccctccagaatctaagagcgatagcgtttctccaaataaaccgccaataaatcag

SEQ ID NO: 8596 - DNA, 305 bp, Homo sapiens
ggctaatttacaaaaaaaattctataattaaaatcagtaaataatagcatatgtatcgtttaacatgttaattaatagccagagtaaatccctgcacactatggtattgttaccttagtgagtcataggatgtaagcataataaataactgtacatttggcataataaatgtgtaaaataagtacttcagacgtcattatttagcagtttaaaaatgatgccaactgcatatggaatatttaatgaagttttcttgtgggaatacagaaattgattttatcaaaggattaaacagattttttaaa

SEQ ID NO: 8597 - DNA, 536 bp, Homo sapiens
tattaaattccttcaatcaatgactgtatattagttagagaatagcataaagttccttttgcctatcattttgaagataatgtgacttctgcaacccacctacaaagcacttttaaacttcgtcagacctgcattaacctattgtcaacctactttagtaaaggaggctttgacaataattttcttcaatgacatacagtattttatagttagtcataagctttcaccactagctttgacaatgatatactgcgatctttggtcttctggaataagttatctacaataaagaagtccttaatgacatcaacatccctactgtgactaagcagaagcatgcttttatttccttgctactgcagaaatactaagatcaatatatttaaggtaaagcaaaaaaaaagaaaaaaaacacgcaaaaatcccataacaaaatatagatgaaaaattgtggctctgtgggtggcatcctttgcttgtatgtaccaagttcttccggggatagactataaaattggtttcagacagtgtttgag

SEQ ID NO: 8598 - DNA, 880 bp, Homo sapiens
ctaactgatatgccggtaggatggggggaccttgccacaaggtataattgtggtgggatggctgtgtcttgctcccattcaggatccatggaaagctcctcctccttcctgttcccctggatgccaagcgatgggcctgagaccctggctttgccatgtggatgctccccctcaggactttggatgtgcagtgattgctacaaaaagggcaatgaagatgcctggaccacagccacacagtctccatcacagcagtggtattctgtggaatgagtactaattttctggccacattttctgttaaaaactggttgttgagctgcccacttgtcttggtcaagggatgctggagtggcctgggaaggcagtgttgtttgcttttcttaggatggaacacacttaggcatatttttggtcaaagcaaaagaagaattcaaaggtgagagaagttgaagataaaaaggggaaaatgagggtagcagatgaagcaaagtcacacagaaagctggcaggcgagtagtagaatcagagtacaggctgagcatcccaaatctgaaaatccaaaatcggaagtgctccaaaacctgaaacttttggagcaccaacacaatgctcaaagtaaatgctcagtgaagcattttggatttcatattttcagatttgggtttgcccaaccggtgtaatacaaatattccaaaatcaaaaaaaaaaaaaaaaaaaaatctaaagtctgaaacactcctggtcccaagcattttgaatacaggatactcaacctgtatgacactttcctattggaccctctttcctaccccaaataatacttaataagtttttgtttcaaaagtgccactctgagcatctttggctataaggagca

SEQ ID NO: 8599 - DNA, 611 bp, Homo sapiens
ccagtgctgttggtatctctgcctcctttcatactgtttctaagtgtttgtaactattcaatgtagagagtatcttttatatctcaattaggtcattgcaattcccctagctttttgttccttctcccaaattatatatgtaacgtggggaaaagcaagttgaaagatgagtgtgctgctattaggggaaagacaggttaaataagggaaattattctaaggttgacttgtccatctctcaaaatctgattgtgtcttctcccgaattttatcttcgatactgagccactcttttccctgtgccttcccaaactctgtagctattccttttattttcaattgctccctaatgcatcttttaaacaaccattaaagctgtggtacattacttataataagtactcaatacatgtttcttcacgttttcagtgccttacattaattttaaaatttgaacttttagatgcactttcacttaggatgtttggacctcgtagcagctctgacaaattccttcgtaccactcattcactaggttatatttagctagtgaggaaactaaaacgtaaaaagttgagccacctcattctcaattcttcatgccttccgtt

SEQ ID NO: 8600 - DNA, 959 bp, Homo sapiens
gtcttccctatcttctgccatattctaagctttgcatatgttctcctgaggaacaggatagttataacttaaacttgcatttatatatttctgattaagttgttaactatggttctagatagaagaataaagaagtaaaattagatttcttaatttgatatatttaagtcccttattttgatctaatatatttgataaaatagtaatcttttaatagtagccctgttatacataataataatacctatcagatagggttgtggtgaggattagaccatatagtaaatgtaacatgtctagtgctgtgccctgaacttaacacgtgcttattaaatattaactattgctattaccattatcatcatcattaataaacatctatattttatatccccatgacttaatgtacagtataaagcataaatagtaaaattacccaaagacaaagaggaatgggaaggtccagttgattagcttcttgtttagagaagcagattattccgggggttaggaaatagtttcctgtaaggcatgtttagctttcattcatggattgatggcaatataaatcgctcttttgatgtgagaaaaatataatgatggcattacatcaattataaatttcatgagggtagggactgtgttcggtttaccttgtgtccttagctcccattttaatgtctgacccatggaaggcatttcattaaatatttgttgtcatctgtctatgttttcttctttgtctttctttagcttccaaaaagagttgtttttatattcataatttcttatttcatcagtaatgtgactcccctagaagtattggttaaaatacagatctttcttggaaggagactgttttgtttgaagcaaatgacttgggagatgacttaagaacattcaggctttaggtgtttttgtagaaagactaatatttggtcctaaaaaacaaaaaaaac

SEQ ID NO: 8601 - DNA, 550 bp, Homo sapiens
tcagacgaattcctgggaactgcggatatagctcgccacagtatcttatcagttaattgcattcttggatgtgctgggagtcagcttgcacaagttaagtccttgaggaaggggctgccagtgaaagagccaagatggagtctgtctggctctcttatgtaagggagagtcaattcaggtggaaacaagtctaggtgattaaaggaaagggagaatctaaaaacagggttagtaaaaacaaggttgggcattacatcacagaatcctctagtgagaactgatagtggaacagtgtgctcgttggtgaccttacctcgttagatgcagtctttattttttatttttttgagacggagtttcactcttgttgcccaggctggatgcaatggcgtgatctcggctcaccgcaatctccgcctcctgggttcaagcgattctcctgcctcagcctcccgagtaggtgtcattacaggcatgcgccactgcacctggctaattttttgtatgtttagtagagatggagtttctccatgtaggtcaggctggtctc

SEQ ID NO: 8602 - DNA, 720 bp, Homo sapiens
cagcagtgcaaagccctgaggtgggagtgtacatggcatcctgaaagaaaagcaagagggccaggatagcgggggcagagcaagctggccagggtggtgggaaatgaggcctcagaagtggctgggccagttgcgcagggctttgtggctttcgttctcagtaaaatgggagaccattacagggttttgggcagaggagtgacataatttttcggtatttattttgaaaattttcaaacctacagaaaagttacaataatggtacaaagaaccaatgtatatccttcacattgattcatcagttgttaacattttgcctatgcttctcacctaccatacacacttattttaggggaacaaggtaacaagaagttgcagacttcatgaatcttcaccctaaaatattttgctatatatctcataagagcaaagatactgtcttatgtaggtacaatgcatttatcaaattgaggaaatttaacactaataaaatattactatataaaatatacagtccatattcagattgctccatttgtcccttacttacttttgtgacactttgtttttcctgcttcagggtccaattcaagattactcttgacatttattgtcatgatattgtctgtttggtaatcctttattttggaagagtttctcagtctttgtctttcataacattgacgtttttaaaaagatagccagttcttctgtagaatg

SEQ ID NO: 8603 - DNA, 2268 bp, Homo sapiens
  misc_feature (1580)..(1580): n is a, c, g, or t
gtgttgatatgtgagaatgtgtgtgtatgtcactgtggggaggtggctccaggcttcctggtgtgcccggggtggccacagtaaggaggctgcactcaggccctgcccgtactcctgccctccccgggtggcccaaccttgtgtgactgcaagtgactggaggaggccagggggttggaggacgtgtccaggtcctatgtcacaggccaggggcacatccacacacctgcgcccctggctgagctgtgttgtcagggaccctcagcacctgggaaggtgtggggaggccaagaggccaggtcctaggaaggcttgtagtggacccttcatctgcccaggggatccatttgtggggtcaagggaggtcctccagccaggcccaccccgaccccggccagagcatcttccccacccctgggctcccacccagctgcccactggcccacgtccctacctgtccccggttcttgccgctccctgtcctgggaggcaggttgggatctggccttacttccagtaaaatgacttctctttcatattaggccaaggcgagagagcggagacatttatgaaactttgtttaatgtactgaaaagccatcggccagaacatttaggaaattgattttcctggcattgatgaactcgttttattttaccccagtattaattacttttttttaaaacaaattaatttaagagtcgtaaaacctaacaagtgagccaaacgtccatagatcgtgtcctgctccgcccctccccacactgaccccctccctctatgggtgggggcccccagtggggggacctcctgtccctcccactccctcccagaggtgatgcgcccccatcctcctctgcaggagaggcctcctcgctgcgggactacgcggcctccaccatgaccgagttcctcggcatgtttggctatgatgaccagaacacgcgggacgagctggccaggaagatcagctttgagaagctgcacgcgggctccaccccggaggcagccacctcctccatgctgcccacctccgaggataccctcagcaagcgggcgcggttctctaagtatgaggagtacatccgcaagctcaaggctggcgagcagctctcctggccggcccccagcaccaagaccgaggagcgggtgggcaaggaggtggtgggcaccctgcccggcctgcggctgcccagcagcacggcccacctggagaccaaggccaccatcctgcccctgccgtcgcacagcagtgtccagatgcagaacctggtagcccgggcctccaagtacgacttcttcatccaaaaactgaagaccggcgagaatctgcggccccagaacgggagcacctacaagaagccatccaagtacgacctggagaatgtcaagtacctgcacctcttcaaacccggggagggcagccccgacatgggcggggccatcgccttcaagacaggcaaggtggggcgcccttccaagtacgacgtccggggcatccagaagccaggccccgccaaggttccgcccacccccagcctggctcccgcacccctcgccagcgtgcccagtgcccccancgcccccgggccagggccagagcctcctgcctccctgtccttcaacactcccgagtacctgaagtcaaccttctccaaaacagactccatcaccacggggaccgtctccactgtcaagaacggactgcccacagataaaccagccgtcactgaagatgtaaacatttaccagaaatatattgccaggtaggcccctggggaggagcctgccgtggagagaaggtggggggccaggactgaccgggcactctgaggccattcgtttgatatctgacctctagggccaaggtagctgcctcctcccatccccatccacttcggtccctccaccgcaccgagggctgccctgcacgcccgtttgggagcctccctctgctctgtgtagtccaggccacacattccctcagcagcctgtgcccccagttagggccggggtcccgacgcagggcctggccacaggtgagtgcagctcccccagcttgcctgggtcctgctgtcacacagagccttgagtagggtgcaggccaccgtgaaactgtcagggctgggaaggtagaggcaggccaggtgcagtggctcatgcctgtaatcccagcactgtgggaggccaagatgggaggatcacttgaggccaggagtttgagatcatcctgggcaacagagtgagaccctatctctttaaaaaaac

SEQ ID NO: 8604 - DNA, 933 bp, Homo sapiens
taggggactggggtgttgttggataccaatgcgctgtggcctgtgtgcgccgtttacacggcacacccgcctccatcatggagaggatctctgcaagcaagggcctcatctcgcccatgatggccaggctggctgcagctgccctcaagccctctgccacctttgacccaggtgagcaggctgggtcctgcccagaaagcaggcaccttctggactggggtggccacctggcctcaggctgcagagcagagtcggggggtgtttggaagaagtgtccgtgtggcccctgcttgccagcaccccctctttgcctgatcttcgcccccatcctgttggtttctatgtggggcccctggttctggctccccacagtaggggggccatgcttctgtttccccatctgtgagctgggggcgatggtccctgcctcctcggctgccctgcatccctggggccactgcaggtcccccctccctgtctgctcaccctcccacatcccaagtccaccctgataagagcaggcccagggcccctggcgtgccgagcgtttcctccagctgacctggagcagggcctgcgtccagcccagcggtagtggggctgcacctcacacctggacacctccaggcccagggacgcccttcccaggctccctcctccatgagtgccattgcagtaggactttccaggccttggaagccttctattctgcagtgtttgacttggcagccactggccacgtgtgactgttggtgcttgaagctgggtctgtgattgggaagcgggattgtcactttaaacaaccacacttggccagggactgccacgtcagacagaaaagggccagagccccggagttgcatcttccttcttcacgctggttcactgaggggcgcagttctctttcctgccttcctataatttcataaatat

SEQ ID NO: 8605 - DNA, 4363 bp, Homo sapiens
  misc_feature (1580)..(1580): n is a, c, g, or t
gtgttgatatgtgagaatgtgtgtgtatgtcactgtggggaggtggctccaggcttcctggtgtgcccggggtggccacagtaaggaggctgcactcaggccctgcccgtactcctgccctccccgggtggcccaaccttgtgtgactgcaagtgactggaggaggccagggggttggaggacgtgtccaggtcctatgtcacaggccaggggcacatccacacacctgcgcccctggctgagctgtgttgtcagggaccctcagcacctgggaaggtgtggggaggccaagaggccaggtcctaggaaggcttgtagtggacccttcatctgcccaggggatccatttgtggggtcaagggaggtcctccagccaggcccaccccgaccccggccagagcatcttccccacccctgggctcccacccagctgcccactggcccacgtccctacctgtccccggttcttgccgctccctgtcctgggaggcaggttgggatctggccttacttccagtaaaatgacttctctttcatattaggccaaggcgagagagcggagacatttatgaaactttgtttaatgtactgaaaagccatcggccagaacatttaggaaattgattttcctggcattgatgaactcgttttattttaccccagtattaattacttttttttaaaacaaattaatttaagagtcgtaaaacctaacaagtgagccaaacgtccatagatcgtgtcctgctccgcccctccccacactgaccccctccctctatgggtgggggcccccagtggggggacctcctgtccctcccactccctcccagaggtgatgcgcccccatcctcctctgcaggagaggcctcctcgctgcgggactacgcggcctccaccatgaccgagttcctcggcatgtttggctatgatgaccagaacacgcgggacgagctggccaggaagatcagctttgagaagctgcacgcgggctccaccccggaggcagccacctcctccatgctgcccacctccgaggataccctcagcaagcgggcgcggttctctaagtatgaggagtacatccgcaagctcaaggctggcgagcagctctcctggccggcccccagcaccaagaccgaggagcgggtgggcaaggaggtggtgggcaccctgcccggcctgcggctgcccagcagcacggcccacctggagaccaaggccaccatcctgcccctgccgtcgcacagcagtgtccagatgcagaacctggtagcccgggcctccaagtacgacttcttcatccaaaaactgaagaccggcgagaatctgcggccccagaacgggagcacctacaagaagccatccaagtacgacctggagaatgtcaagtacctgcacctcttcaaacccggggagggcagccccgacatgggcggggccatcgccttcaagacaggcaaggtggggcgcccttccaagtacgacgtccggggcatccagaagccaggccccgccaaggttccgcccacccccagcctggctcccgcacccctcgccagcgtgcccagtgcccccancgcccccgggccagggccagagcctcctgcctccctgtccttcaacactcccgagtacctgaagtcaaccttctccaaaacagactccatcaccacggggaccgtctccactgtcaagaacggactgcccacagataaaccagccgtcactgaagatgtaaacatttaccagaaatatattgccaggttctcgggcagccagcactgtggccacatccactgtgcctaccagtaccgcgagcactaccactgccttgaccctgagtgtaactaccagaggttcacgagtaagcaggacgtgatccgccactacaacatgcacaagaagcgcgacaactccctgcagcacggcttcatgcgtttcagcccgctggacgactgcagcgtctactaccacggctgccacctcaatgggaagagcacccactatcactgcatgcaggtgggctgtaacaaggtgtacacgagcacgtctgacgtgatgacccacgagaacttccacaagaagaatacccagctcattaacgacggcttccagcgcttccgagccaccgaagactgtggcacagccgactgccagttctacggacagaagaccacgcacttccactgcaggcgccccggctgcacattcactttcaagaacaagtgtgacatcgagaagcacaagagctaccacatcaaggacgatgcctacgccaaggacggcttcaagaagttctacaagtacgaggagtgcaagtacgagggctgcgtgtacagcaaggctaccaaccacttccactgcatccgcgccggctgcggcttcaccttcacctccaccagccagatgacctctcacaagcgcaagcatgagcgccggcacatccgctcctcgggcgcgctggggctgccgccctcgctgctgggcgccaaggacacggagcacgaggagtccagcaacgacgaccttgttgacttctccgccctgagcagcaagaactccagcctgagcgcctcccctaccagccagcagtcctctgcgtccctggctgccgccactgccgccaccgaggctgggcccagtgccaccaaacctcccaacagcaagatctcggggctgctgccccagggcctgcctggctcaatccccctggccctggccctctccaactcgggcctgcccacccccacgccctacttccccatactggctggccgtgggagcacctccctgcctgtgggcacccccagcctcctgggtgccgtgtcgtctgggtcagcagcctcagccacccctgacacacccacgctggtcgcctcgggagctggagactcagcccccgtggctgccgcctctgtcccggcaccacccgcctccatcatggagaggatctctgcaagcaagggcctcatctcgcccatgatggccaggctggctgcagctgccctcaagccctctgccacctttgacccaggaagcgggcagcaggtcaccccagccaggttccccccggcccaagtgaagccggaacccggtgagagcaccggcgccccaggcccccacgaagcctcccaggaccgcagtctagacctgactgtgaaggagcccagcaacgaatcaaatggccacgcagtcccggcaaattcatctcttttatcctcgcttatgaataagatgtctcagggcaaccctggcctgggcagcctgctgaacatcaaggcggaagcggaggggagccccgctgcggagccctcgcccttcctaggcaaggccgtgaaggcgctggttcaggagaagttggcagagccctggaaggtgtacctgcgcaggtttggtacaaaggacttctgtgacggccagtgtgacttcctccacaaggcccacttccactgcgtggtggaggaatgcggcgcgctcttcagcaccttggacggggccatcaagcacgcaaacttccacttccggacagagggaggagcagcaaaaggaaacacagaggctgcctttccggcctcggccgccgagaccaaacctcccatggccccctcgtcccctccggtccctcctgtcaccacggccacggtgtcctctctggaggggcccgctcccagcccggcctccgtgccctccacccccaccctgctcgcctggaagcagctggcttccaccataccccagatgcctcagatcccagcgtcagtgcctcacctgcccgcctcgcccttggcaacgacttctctagagaacgccaagccccaggtcaaacccggattcctccagttccaggagaacgatccttgcctcgccacggactgcaagtacgccaacaagttccacttccactgtctctttgggaactgcaagtacgtctgcaaaacgtctggcaaggccgaatcccactgcctggaccacatcaaccccaacaacaacctggtgaacgtgcgagaccagtttgcatactactctctgcagtgtctctgtcccaaccagcactgcgagttccgaatgcgtgggcactaccactgcctccgcaccggctgctattttgtgaccaacatcaccaccaagctcccctggcacatcaagaagcatgagaaggcggacgggcgggcagccaatggcttcaaatacttcaccaagcgcgaggagtgtggcaggctaggttgcaagtacaaccaggtgaacagccacttccactgcatccgggagggctgccagttctccttcctcctcaagcaccagatgacctcccacgcgcggaagcacatgcggaggatgctggggaagaacttcgaccgcg

SEQ ID NO: 8606 - DNA, 3445 bp, Homo sapiens
  misc_feature (1580)..(1580): n is a, c, g, or t
gtgttgatatgtgagaatgtgtgtgtatgtcactgtggggaggtggctccaggcttcctggtgtgcccggggtggccacagtaaggaggctgcactcaggccctgcccgtactcctgccctccccgggtggcccaaccttgtgtgactgcaagtgactggaggaggccagggggttggaggacgtgtccaggtcctatgtcacaggccaggggcacatccacacacctgcgcccctggctgagctgtgttgtcagggaccctcagcacctgggaaggtgtggggaggccaagaggccaggtcctaggaaggcttgtagtggacccttcatctgcccaggggatccatttgtggggtcaagggaggtcctccagccaggcccaccccgaccccggccagagcatcttccccacccctgggctcccacccagctgcccactggcccacgtccctacctgtccccggttcttgccgctccctgtcctgggaggcaggttgggatctggccttacttccagtaaaatgacttctctttcatattaggccaaggcgagagagcggagacatttatgaaactttgtttaatgtactgaaaagccatcggccagaacatttaggaaattgattttcctggcattgatgaactcgttttattttaccccagtattaattacttttttttaaaacaaattaatttaagagtcgtaaaacctaacaagtgagccaaacgtccatagatcgtgtcctgctccgcccctccccacactgaccccctccctctatgggtgggggcccccagtggggggacctcctgtccctcccactccctcccagaggtgatgcgcccccatcctcctctgcaggagaggcctcctcgctgcgggactacgcggcctccaccatgaccgagttcctcggcatgtttggctatgatgaccagaacacgcgggacgagctggccaggaagatcagctttgagaagctgcacgcgggctccaccccggaggcagccacctcctccatgctgcccacctccgaggataccctcagcaagcgggcgcggttctctaagtatgaggagtacatccgcaagctcaaggctggcgagcagctctcctggccggcccccagcaccaagaccgaggagcgggtgggcaaggaggtggtgggcaccctgcccggcctgcggctgcccagcagcacggcccacctggagaccaaggccaccatcctgcccctgccgtcgcacagcagtgtccagatgcagaacctggtagcccgggcctccaagtacgacttcttcatccaaaaactgaagaccggcgagaatctgcggccccagaacgggagcacctacaagaagccatccaagtacgacctggagaatgtcaagtacctgcacctcttcaaacccggggagggcagccccgacatgggcggggccatcgccttcaagacaggcaaggtggggcgcccttccaagtacgacgtccggggcatccagaagccaggccccgccaaggttccgcccacccccagcctggctcccgcacccctcgccagcgtgcccagtgcccccancgcccccgggccagggccagagcctcctgcctccctgtccttcaacactcccgagtacctgaagtcaaccttctccaaaacagactccatcaccacggggaccgtctccactgtcaagaacggactgcccacagataaaccagccgtcactgaagatgtaaacatttaccagaaatatattgccaggttctcgggcagccagcactgtggccacatccactgtgcctaccagtaccgcgagcactaccactgccttgaccctgagtgtaactaccagaggttcacgagtaagcaggacgtgatccgccactacaacatgcacaagaagcgcgacaactccctgcagcacggcttcatgcgtttcagcccgctggacgactgcagcgtctactaccacggctgccacctcaatgggaagagcacccactatcactgcatgcaggtgggctgtaacaaggtgtacacgagcacgtctgacgtgatgacccacgagaacttccacaagaagaatacccagctcattaacgacggcttccagcgcttccgagccaccgaagactgtggcacagccgactgccagttctacggacagaagaccacgcacttccactgcaggcgccccggctgcacattcactttcaagaacaagtgtgacatcgagaagcacaagagctaccacatcaaggacgatgcctacgccaaggacggcttcaagaagttctacaagtacgaggagtgcaagtacgagggctgcgtgtacagcaaggctaccaaccacttccactgcatccgcgccggctgcggcttcaccttcacctccaccagccagatgacctctcacaagcgcaagcatgagcgccggcacatccgctcctcgggcgcgctggggctgccgccctcgctgctgggcgccaaggacacggagcacgaggagtccagcaacgacgaccttgttgacttctccgccctgagcagcaagaactccagcctgagcgcctcccctaccagccagcagtcctctgcgtccctggctgccgccactgccgccaccgaggctgggcccagtgccaccaaacctcccaacagcaagatctcggggctgctgccccagggcctgcctggctcaatccccctggccctggccctctccaactcgggcctgcccacccccacgccctacttccccatactggctggccgtgggagcacctccctgcctgtgggcacccccagcctcctgggtgccgtgtcgtctgggtcagcagcctcagccacccctgacacacccacgctggtcgcctcgggagctggagactcagcccccgtggctgccgcctctgtcccggcaccacccgcctccatcatggagaggatctctgcaagcaagggcctcatctcgcccatgatggccaggctggctgcagctgccctcaagccctctgccacctttgacccaggaagcgggcagcaggtcaccccagccaggttccccccggcccaagtgaagccggaacccggtgagagcaccggcgccccaggcccccacgaagcctcccaggaccgcagtctagacctgactgtgaaggagcccagcaacgaatcaaatggccacgcagtcccggcaaattcatctcttttatcctcgcttatgaataaggtaagagccatccatcacacgcctcccgttcccccacccagagaaattaaagctgtgctggggggtggggggatgtgtttgttttttaatgttttgcctctaataagatgagtttgtaccatttaaattttgaggccatttttcatcggatataatttcagagccactgcttacaaattaatttaatgaactggctgaagaaatatat

SEQ ID NO: 8607 - DNA, 3755 bp, Homo sapiens
  misc_feature (883)..(883): n is a, c, g, or t
aagagctgcctcccgagggtgtctacatggtgcagccccaggggtgcagcgatgaggaagaccacgcggaggagccctccaaggacggcggtgccctggaggagaaggattcggacggggcagcctccaaggaggacagcggccccagcaccaggcaggcttcaggagaggcctcctcgctgcgggactacgcggcctccaccatgaccgagttcctcggcatgtttggctatgatgaccagaacacgcgggacgagctggccaggaagatcagctttgagaagctgcacgcgggctccaccccggaggcagccacctcctccatgctgcccacctccgaggataccctcagcaagcgggcgcggttctctaagtatgaggagtacatccgcaagctcaaggctggcgagcagctctcctggccggcccccagcaccaagaccgaggagcgggtgggcaaggaggtggtgggcaccctgcccggcctgcggctgcccagcagcacggcccacctggagaccaaggccaccatcctgcccctgccgtcgcacagcagtgtccagatgcagaacctggtagcccgggcctccaagtacgacttcttcatccaaaaactgaagaccggcgagaatctgcggccccagaacgggagcacctacaagaagccatccaagtacgacctggagaatgtcaagtacctgcacctcttcaaacccggggagggcagccccgacatgggcggggccatcgccttcaagacaggcaaggtggggcgcccttccaagtacgacgtccggggcatccagaagccaggccccgccaaggttccgcccacccccagcctggctcccgcacccctcgccagcgtgcccagtgcccccancgcccccgggccagggccagagcctcctgcctccctgtccttcaacactcccgagtacctgaagtcaaccttctccaaaacagactccatcaccacggggaccgtctccactgtcaagaacggactgcccacagataaaccagccgtcactgaagatgtaaacatttaccagaaatatattgccaggttctcgggcagccagcactgtggccacatccactgtgcctaccagtaccgcgagcactaccactgccttgaccctgagtgtaactaccagaggttcacgagtaagcaggacgtgatccgccactacaacatgcacaagaagcgcgacaactccctgcagcacggcttcatgcgtttcagcccgctggacgactgcagcgtctactaccacggctgccacctcaatgggaagagcacccactatcactgcatgcaggtgggctgtaacaaggtgtacacgagcacgtctgacgtgatgacccacgagaacttccacaagaagaatacccagctcattaacgacggcttccagcgcttccgagccaccgaagactgtggcacagccgactgccagttctacggacagaagaccacgcacttccactgcaggcgccccggctgcacattcactttcaagaacaagtgtgacatcgagaagcacaagagctaccacatcaaggacgatgcctacgccaaggacggcttcaagaagttctacaagtacgaggagtgcaagtacgagggctgcgtgtacagcaaggctaccaaccacttccactgcatccgcgccggctgcggcttcaccttcacctccaccagccagatgacctctcacaagcgcaagcatgagcgccggcacatccgctcctcgggcgcgctggggctgccgccctcgctgctgggcgccaaggacacggagcacgaggagtccagcaacgacgaccttgttgacttctccgccctgagcagcaagaactccagcctgagcgcctcccctaccagccagcagtcctctgcgtccctggctgccgccactgccgccaccgaggctgggcccagtgccaccaaacctcccaacagcaagatctcggggctgctgccccagggcctgcctggctcaatccccctggccctggccctctccaactcgggcctgcccacccccacgccctacttccccatactggctggccgtgggagcacctccctgcctgtgggcacccccagcctcctgggtgccgtgtcgtctgggtcagcagcctcagccacccctgacacacccacgctggtcgcctcgggagctggagactcagcccccgtggctgccgcctctgtcccggcaccacccgcctccatcatggagaggatctctgcaagcaagggcctcatctcgcccatgatggccaggctggctgcagctgccctcaagccctctgccacctttgacccaggaagcgggcagcaggtcaccccagccaggttccccccggcccaagtgaagccggaacccggtgagagcaccggcgccccaggcccccacgaagcctcccaggaccgcagtctagacctgactgtgaaggagcccagcaacgaatcaaatggccacgcagtcccggcaaattcatctcttttatcctcgcttatgaataagatgtctcagggcaaccctggcctgggcagcctgctgaacatcaaggcggaagcggaggggagccccgctgcggagccctcgcccttcctaggcaaggccgtgaaggcgctggttcaggagaagttggcagagccctggaaggtgtacctgcgcaggtttggtacaaaggacttctgtgacggccagtgtgacttcctccacaaggcccacttccactgcgtggtggaggaatgcggcgcgctcttcagcaccttggacggggccatcaagcacgcaaacttccacttccggacagagggaggagcagcaaaaggaaacacagaggctgcctttccggcctcggccgccgagaccaaacctcccatggccccctcgtcccctccggtccctcctgtcaccacggccacggtgtcctctctggaggggcccgctcccagcccggcctccgtgccctccacccccaccctgctcgcctggaagcagctggcttccaccataccccagatgcctcagatcccagcgtcagtgcctcacctgcccgcctcgcccttggcaacgacttctctagagaacgccaagccccaggtcaaacccggattcctccagttccaggagaagtgagtccctcgatgagccgggagtcccgcgttcccctcgcgtctcgggagtaggtgctagcaagggcgctaggaggccctgttcctcactgcggatggtgctgctgtccccagcctctctggggcatggccatcgggtgatgtccttctagccaaagatgctgctgctcctacctcactgcctgtcccagagcaggccagcccgcgtgggccgatggtggcggcagtggctactgctcctgcagggcatgtggtgatcctgccagggccaggtggggtggactgggcgtggtggtcctcagaggacaactcccagcctgacaaggagggctgcgtctccctccgagcctccgtattggcctcctctgtggctcacacccatggctgaatctctgcagggcacgtgaagtcacgggtaggggccaggcccctccaggccgtcactggcctgcacagtggtctgagctcttgggtggaagggaccctcctcactggatggtggtggctccttgcagggagaacggtgactttgtattgtcatgtgtgcggcttcctgttctcaataaaagtaataaattggattatttatatcgcctga

SEQ ID NO: 8608 - DNA, 4452 bp, Homo sapiens
  misc_feature (1580)..(1580): n is a, c, g, or t
gtgttgatatgtgagaatgtgtgtgtatgtcactgtggggaggtggctccaggcttcctggtgtgcccggggtggccacagtaaggaggctgcactcaggccctgcccgtactcctgccctccccgggtggcccaaccttgtgtgactgcaagtgactggaggaggccagggggttggaggacgtgtccaggtcctatgtcacaggccaggggcacatccacacacctgcgcccctggctgagctgtgttgtcagggaccctcagcacctgggaaggtgtggggaggccaagaggccaggtcctaggaaggcttgtagtggacccttcatctgcccaggggatccatttgtggggtcaagggaggtcctccagccaggcccaccccgaccccggccagagcatcttccccacccctgggctcccacccagctgcccactggcccacgtccctacctgtccccggttcttgccgctccctgtcctgggaggcaggttgggatctggccttacttccagtaaaatgacttctctttcatattaggccaaggcgagagagcggagacatttatgaaactttgtttaatgtactgaaaagccatcggccagaacatttaggaaattgattttcctggcattgatgaactcgttttattttaccccagtattaattacttttttttaaaacaaattaatttaagagtcgtaaaacctaacaagtgagccaaacgtccatagatcgtgtcctgctccgcccctccccacactgaccccctccctctatgggtgggggcccccagtggggggacctcctgtccctcccactccctcccagaggtgatgcgcccccatcctcctctgcaggagaggcctcctcgctgcgggactacgcggcctccaccatgaccgagttcctcggcatgtttggctatgatgaccagaacacgcgggacgagctggccaggaagatcagctttgagaagctgcacgcgggctccaccccggaggcagccacctcctccatgctgcccacctccgaggataccctcagcaagcgggcgcggttctctaagtatgaggagtacatccgcaagctcaaggctggcgagcagctctcctggccggcccccagcaccaagaccgaggagcgggtgggcaaggaggtggtgggcaccctgcccggcctgcggctgcccagcagcacggcccacctggagaccaaggccaccatcctgcccctgccgtcgcacagcagtgtccagatgcagaacctggtagcccgggcctccaagtacgacttcttcatccaaaaactgaagaccggcgagaatctgcggccccagaacgggagcacctacaagaagccatccaagtacgacctggagaatgtcaagtacctgcacctcttcaaacccggggagggcagccccgacatgggcggggccatcgccttcaagacaggcaaggtggggcgcccttccaagtacgacgtccggggcatccagaagccaggccccgccaaggttccgcccacccccagcctggctcccgcacccctcgccagcgtgcccagtgcccccancgcccccgggccagggccagagcctcctgcctccctgtccttcaacactcccgagtacctgaagtcaaccttctccaaaacagactccatcaccacggggaccgtctccactgtcaagaacggactgcccacagataaaccagccgtcactgaagatgtaaacatttaccagaaatatattgccaggttctcgggcagccagcactgtggccacatccactgtgcctaccagtaccgcgagcactaccactgccttgaccctgagtgtaactaccagaggttcacgagtaagcaggacgtgatccgccactacaacatgcacaagaagcgcgacaactccctgcagcacggcttcatgcgtttcagcccgctggacgactgcagcgtctactaccacggctgccacctcaatgggaagagcacccactatcactgcatgcaggtgggctgtaacaaggtgtacacgagcacgtctgacgtgatgacccacgagaacttccacaagaagaatacccagctcattaacgacggcttccagcgcttccgagccaccgaagactgtggcacagccgactgccagttctacggacagaagaccacgcacttccactgcaggcgccccggctgcacattcactttcaagaacaagtgtgacatcgagaagcacaagagctaccacatcaaggacgatgcctacgccaaggacggcttcaagaagttctacaagtacgaggagtgcaagtacgagggctgcgtgtacagcaaggctaccaaccacttccactgcatccgcgccggctgcggcttcaccttcacctccaccagccagatgacctctcacaagcgcaagcatgagcgccggcacatccgctcctcgggcgcgctggggctgccgccctcgctgctgggcgccaaggacacggagcacgaggagtccagcaacgacgaccttgttgacttctccgccctgagcagcaagaactccagcctgagcgcctcccctaccagccagcagtcctctgcgtccctggctgccgccactgccgccaccgaggctgggcccagtgccaccaaacctcccaacagcaagatctcggggctgctgccccagggcctgcctggctcaatccccctggccctggccctctccaactcgggcctgcccacccccacgccctacttccccatactggctggccgtgggagcacctccctgcctgtgggcacccccagcctcctgggtgccgtgtcgtctgggtcagcagcctcagccacccctgacacacccacgctggtcgcctcgggagctggagactcagcccccgtggctgccgcctctgtcccggcaccacccgcctccatcatggagaggatctctgcaagcaagggcctcatctcgcccatgatggccaggctggctgcagctgccctcaagccctctgccacctttgacccaggaagcgggcagcaggtcaccccagccaggttccccccggcccaagtgaagccggaacccggtgagagcaccggcgccccaggcccccacgaagcctcccaggaccgcagtctagacctgactgtgaaggagcccagcaacgaatcaaatggccacgcagtcccggcaaattcatctcttttatcctcgcttatgaataagatgtctcagggcaaccctggcctgggcagcctgctgaacatcaaggcggaagcggaggggagccccgctgcggagccctcgcccttcctaggcaaggccgtgaaggcgctggttcaggagaagttggcagagccctggaaggtgtacctgcgcaggtttggtacaaaggacttctgtgacggccagtgtgacttcctccacaaggcccacttccactgcgtggtggaggaatgcggcgcgctcttcagcaccttggacggggccatcaagcacgcaaacttccacttccggacagagggaggagcagcaaaaggaaacacagaggctgcctttccggcctcggccgccgagaccaaacctcccatggccccctcgtcccctccggtccctcctgtcaccacggccacggtgtcctctctggaggggcccgctcccagcccggcctccgtgccctccacccccaccctgctcgcctggaagcagctggcttccaccataccccagatgcctcagatcccagcgtcagtgcctcacctgcccgcctcgcccttggcaacgacttctctagagaacgccaagccccaggtcaaacccggattcctccagttccaggagaagtgagtccctcgatgagccgggagtcccgcgttcccctcgcgtctcgggagtaggtgctagcaagggcgctaggaggccctgttcctcactgcggatggtgctgctgtccccagcctctctggggcatggccatcgggtgatgtccttctagccaaagatgctgctgctcctacctcactgcctgtcccagagcaggccagcccgcgtgggccgatggtggcggcagtggctactgctcctgcagggcatgtggtgatcctgccagggccaggtggggtggactgggcgtggtggtcctcagaggacaactcccagcctgacaaggagggctgcgtctccctccgagcctccgtattggcctcctctgtggctcacacccatggctgaatctctgcagggcacgtgaagtcacgggtaggggccaggcccctccaggccgtcactggcctgcacagtggtctgagctcttgggtggaagggaccctcctcactggatggtggtggctccttgcagggagaacggtgactttgtattgtcatgtgtgcggcttcctgttctcaataaaagtaataaattggattatttatatcgcctga

SEQ ID NO: 8609 - DNA, 3799 bp, Homo sapiens
  misc_feature (1580)..(1580): n is a, c, g, or t
gtgttgatatgtgagaatgtgtgtgtatgtcactgtggggaggtggctccaggcttcctggtgtgcccggggtggccacagtaaggaggctgcactcaggccctgcccgtactcctgccctccccgggtggcccaaccttgtgtgactgcaagtgactggaggaggccagggggttggaggacgtgtccaggtcctatgtcacaggccaggggcacatccacacacctgcgcccctggctgagctgtgttgtcagggaccctcagcacctgggaaggtgtggggaggccaagaggccaggtcctaggaaggcttgtagtggacccttcatctgcccaggggatccatttgtggggtcaagggaggtcctccagccaggcccaccccgaccccggccagagcatcttccccacccctgggctcccacccagctgcccactggcccacgtccctacctgtccccggttcttgccgctccctgtcctgggaggcaggttgggatctggccttacttccagtaaaatgacttctctttcatattaggccaaggcgagagagcggagacatttatgaaactttgtttaatgtactgaaaagccatcggccagaacatttaggaaattgattttcctggcattgatgaactcgttttattttaccccagtattaattacttttttttaaaacaaattaatttaagagtcgtaaaacctaacaagtgagccaaacgtccatagatcgtgtcctgctccgcccctccccacactgaccccctccctctatgggtgggggcccccagtggggggacctcctgtccctcccactccctcccagaggtgatgcgcccccatcctcctctgcaggagaggcctcctcgctgcgggactacgcggcctccaccatgaccgagttcctcggcatgtttggctatgatgaccagaacacgcgggacgagctggccaggaagatcagctttgagaagctgcacgcgggctccaccccggaggcagccacctcctccatgctgcccacctccgaggataccctcagcaagcgggcgcggttctctaagtatgaggagtacatccgcaagctcaaggctggcgagcagctctcctggccggcccccagcaccaagaccgaggagcgggtgggcaaggaggtggtgggcaccctgcccggcctgcggctgcccagcagcacggcccacctggagaccaaggccaccatcctgcccctgccgtcgcacagcagtgtccagatgcagaacctggtagcccgggcctccaagtacgacttcttcatccaaaaactgaagaccggcgagaatctgcggccccagaacgggagcacctacaagaagccatccaagtacgacctggagaatgtcaagtacctgcacctcttcaaacccggggagggcagccccgacatgggcggggccatcgccttcaagacaggcaaggtggggcgcccttccaagtacgacgtccggggcatccagaagccaggccccgccaaggttccgcccacccccagcctggctcccgcacccctcgccagcgtgcccagtgcccccancgcccccgggccagggccagagcctcctgcctccctgtccttcaacactcccgagtacctgaagtcaaccttctccaaaacagactccatcaccacggggaccgtctccactgtcaagaacggactgcccacagataaaccagccgtcactgaagatgtaaacatttaccagaaatatattgccaggttctcgggcagccagcactgtggccacatccactgtgcctaccagtaccgcgagcactaccactgccttgaccctgagtgtaactaccagaggttcacgagtaagcaggacgtgatccgccactacaacatgcacaagaagcgcgacaactccctgcagcacggcttcatgcgtttcagcccgctggacgactgcagcgtctactaccacggctgccacctcaatgggaagagcacccactatcactgcatgcaggtgggctgtaacaaggtgtacacgagcacgtctgacgtgatgacccacgagaacttccacaagaagaatacccagctcattaacgacggcttccagcgcttccgagccaccgaagactgtggcacagccgactgccagttctacggacagaagaccacgcacttccactgcaggcgccccggctgcacattcactttcaagaacaagtgtgacatcgagaagcacaagagctaccacatcaaggacgatgcctacgccaaggacggcttcaagaagttctacaagtacgaggagtgcaagtacgagggctgcgtgtacagcaaggctaccaaccacttccactgcatccgcgccggctgcggcttcaccttcacctccaccagccagatgacctctcacaagcgcaagcatgagcgccggcacatccgctcctcgggcgcgctggggctgccgccctcgctgctgggcgccaaggacacggagcacgaggagtccagcaacgacgaccttgttgacttctccgccctgagcagcaagaactccagcctgagcgcctcccctaccagccagcagtcctctgcgtccctggctgccgccactgccgccaccgaggctgggcccagtgccaccaaacctcccaacagcaagatctcggggctgctgccccagggcctgcctggctcaatccccctggccctggccctctccaactcgggcctgcccacccccacgccctacttccccatactggctggccgtgggagcacctccctgcctgtgggcacccccagcctcctgggtgccgtgtcgtctgggtcagcagcctcagccacccctgacacacccacgctggtcgcctcgggagctggagactcagcccccgtggctgccgcctctgtcccggcaccacccgcctccatcatggagaggatctctgcaagcaagggcctcatctcgcccatgatggccaggctggctgcagctgccctcaagccctctgccacctttgacccaggtgagcaggctgggtcctgcccagaaagcaggcaccttctggactggggtggccacctggcctcaggctgcagagcagagtcggggggtgtttggaagaagtgtccgtgtggcccctgcttgccagcaccccctctttgcctgatcttcgcccccatcctgttggtttctatgtggggcccctggttctggctccccacagtaggggggccatgcttctgtttccccatctgtgagctgggggcgatggtccctgcctcctcggctgccctgcatccctggggccactgcaggtcccccctccctgtctgctcaccctcccacatcccaagtccaccctgataagagcaggcccagggcccctggcgtgccgagcgtttcctccagctgacctggagcagggcctgcgtccagcccagcggtagtggggctgcacctcacacctggacacctccaggcccagggacgcccttcccaggctccctcctccatgagtgccattgcagtaggactttccaggccttggaagccttctattctgcagtgtttgacttggcagccactggccacgtgtgactgttggtgcttgaagctgggtctgtgattgggaagcgggattgtcactttaaacaaccacacttggccagggactgccacgtcagacagaaaagggccagagccccggagttgcatcttccttcttcacgctggttcactgaggggcgcagttctctttcctgccttcctataatttcataaatat

SEQ ID NO: 8610 - DNA, 299 bp, Homo sapiens
tttattactactactaaattcgcggccgcgtcgacgcaaactcctccaacactcctcagaccccctaccctgctttatcgaccccagttgcacgtttcaccttggaggatatattttgcatttctgtttacttgttattgcctatctcccctccttgaatgaaagttttactcgggcaggtaccttatcttcttcactgtttatatctgacatctcagcggtacctggtctatagtaggtgtttaataaaaatatttgctaaaaaaaaagtcgacgcggccgcgaatttagtagtagta

SEQ ID NO: 8611 - DNA, 313 bp, Homo sapiens
ccccagtcctggcattgcagaatgggaaagtcaatatcacacgttaactcagagaggccttccctgaccacccagtcccaggacgcaaactcctccaacactcctcagaccccctaccctgctttatcgaccccagttgcacgtttcaccttggaggatatattttgcatttctgtttacttgttattgcctatctcccctccttgaatgaaagttttactcgggcaggtaccttatcttcttcactgtttatatctgacatctcagcggtacctggtctatagtaggtgtttaataaaaatatttgctaaaa

SEQ ID NO: 8612 - DNA, 263 bp, Homo sapiens
ccacacctcacccatgttgctagatttagttaccctaatcacaggcccactgaccagcccattcagcactgtgtaacttatttttggggaaggagactttcttactgaggtctgtgaaagtatgtatcattgctcaaaattccgtttttgtttttaatgagagacatttgtcttttggaataaaccttcacccacagtggtaaaggggataccaagaagcttgtttgacagatattttgaatttggacacaaaaacgtcgacg

SEQ ID NO: 8613 - DNA, 824 bp, Homo sapiens
gtggcttttgcaataaagacatttagttatgtaacataacaggatttaagaggaagaaggcaaggacttgaaaaggctcagtgatgtagctgaggccccagattccttttatcattttgtccaaaggctccaccttcctgaatattactgctttatacccttggagcttcatgatcacaggatggctgttatagctccagccatcatgaccaagttcagactccaggaacaagatggaggaagctatgtcaaggggggcttttcttgatgtgtctctcgcctttaaccagtgaagaaaatcttcttagaaggacacagcagacttctccttatgtctcattatgcagaagtggaccacaggacagtccctactgtaaactctttcaagtatcaggcaaaaaggaacaaaaggccccagcctggcttaaaccaaccttgagtcatcacctgacactggacactttgtttatccaagcaaaatcaggattttctgttagcaagcaaaggaactgctcatgggtaagaaattaacagtgtgtgccataattcatatttgtcgccaagcatcttctcaggctgacactgtgccaaacaagggattatagagatgaagatgcagcttccatccctgaaagctcacagtccattctctcagggcaatcccggtaacctcctcatcacaatcatccatccagatcatggaagtccctttactccccaaataagaaggagtagcaggaaaaagtgacctcatcaagctgactcgagtttttccaaaagcaaataaataaataaataactttttaacctgcacagccaaatat

SEQ ID NO: 8614 - DNA, 313 bp, Homo sapiens
ggggggttggggggtgtttttttttctgagcttcctgtggtattgaaactatctcccacttcctcctttttgtctcaaaagatcttaagcattgggccagacacagtggctcctgcctgtaatcccagtactttgggaggccgaggtgggcagattgctttagcccaggtgttcgagacgagtctgggcaacgtaaaaatagcccatctctaaaaaaataaaataaaataaaagcaggaaaagaggggcaaatgaggagtcgggggacttgtgatcttcatttttgcccagggatggaagctcgtgcccgaat

SEQ ID NO: 8615 - DNA, 421 bp, Homo sapiens
cctgcacagccaaatatcaaataaatacatgtgtgttttttgggggggttggggggtgtttttttttctgagcttcctgtggtattgaaactatctcccacttcctcctttttgtctcaaaagatcttaagcattgggccagacacagtggctcctgcctgtaatcccagtactttgggaggccgaggtgggcagattgctttagcccaggtgttcgagacgagtctgggcaacgtaaaaatagcccatctctaaaaaaataaaataaaataaaatacaaaaattagccaggcatagaggtggatgcatgtagttccagctacctgggaggctgaggtgggaggatcacttgagccccaggggttgaggctgcagtgaaccatgatcatcacatctgggcaacagagcaagaccctgtctc

SEQ ID NO: 8616 - DNA, 461 bp, Homo sapiens
tctcccaaagtgctaggattacagacgtgaaccactgcacccagccaaataattcaaacttaaagctgttggaacttaaattgttctgagtcttgagaggaatgtgactatgcagcctgagtcacatggcatgcagctgcaacttctgccttttttccacctataaataattgagactaagtggtgccagagataaaaccccctcagatcactgccccttctacagagtaataatgtcatcttccttgggatgcagcaatctgtaaccaatcaaatcactgtaacatatgcactgtcttgtatggaaaatgttataatcctgctaaaatttttctgtctgtctctgtataagtaaaaccttaacttcttcactttggaacgctgaacccattcgtttggagttgaggtctcctgggtggtatccgcacactcaaataaactctatgtgtaatcatatttta

SEQ ID NO: 8617 - DNA, 572 bp, Homo sapiens
actagattgatttttcttgcccttgagtgtcacagtggtggcactctatactttaaaaagtgtgaaataacaaccaggagagatagggaaaacccaattggcttttaaaaaaatgaatacatgtcaaagattttatattaggcattaattaataattaattaactggcaaagtaagtggttactgcagtccaaaggaaaatccaaagagtagacacatacataggcaatggagaatgtgaaaatgaatttgttagcagacgcacagctggcttctcccatgggcagggtggagtgtgggattaggtgtgtcttaactggacaagatttgtttgcagtaatatcagtattctttaagagttgtaaatagatcagtaaaaatactaaaaggtgtagtcccctgtagaatcagatagcccagaaaagtgtgctagacaacacctgaagttccgctgaaaagatacccagtgatcactttttgcccatttcaaatctttctcagtttatctgactgtgcttcccccctcctcccctgtgatcgtaataatctcagtgattatccttcatttaaaaa

SEQ ID NO: 8618 - DNA, 218 bp, Homo sapiens
gaacttaaaaagagttatacttccttagtatgagaattgtattgtggttatacaagataatgtccctgttcttctgaacaggaagtggaaaacgtcgacaattctcaaatggctcagaaaaaaaagaaaaacagagacataaacatggcaaaatgttaactaataaatctttgtgaagggtgtatgggtagtaataacacaacttttctttaggtttg

SEQ ID NO: 8619 - DNA, 412 bp, Homo sapiens
cacatatttggatatagttctgttctggcttaaatgttactgtatagaaataaaggtttacagaaggtcattctgtgaacagaggtatggaaagtctacacgtggcacttcctgtgaacagatggcatggtacgttaagagagcataaggtgggatttctgttatgggcaaagggggaaatgaatctgaaaggacagggcaaggtcaaggtggtggaaaggcctttattctatgctgagaagtttgaaccctctgttgccagaggaggtcttgattaaaaaaatcagcctagtagcaatatagaagattgatggaggagaaaggaaagtggtgccagggagactagattgtgatcatttcagtatttaaagttagataaaagctaagtctgaatttcagtaggaacagagga

SEQ ID NO: 8620 - DNA, 574 bp, Homo sapiens
tctgagattccccaaagtggaaagtcctaggaatactgcctgaaatgacagtgcatttgctgttcaggtaaaattctttaggaattttctctgattctgatttctatttctaaaattttcgatcatcttcaccattttcccccaaaaaatgaggggtgcatttctgtcattttgtgtgtggttgggtggtattgttgcgtctcagttaggggttgtgaaatggaagctctggagggaggaaaggcattcttggtttgcaactgagagcaaaaggtaccacctaagcatcttctgtgagactagggtgcttcctttagataaatgtgtatctgtaatcagcttaactaagcaggtaaggtgttcattagctaggcagggttttcaaagagagagagagggagagtgagaggaagagagagagaatgaatgtggaagagtgagaagaacaaacaagtcaaagcatttgttcatgctgcaatctacacatcaattatcccgctgtgctaattaccacctttccataccccaggtacctaagcattcacacttactcactttcatgcctctgatcaaa

SEQ ID NO: 8621 - DNA, 908 bp, Homo sapiens
gtataatatataaccaactgtttcgggctagtgggtttttagaccacatagcctttggggatgatgctgttagaagagcttgcttcgcatttgtttttaaaaagcttttcatccttacagtgcaaattttaagatagaagaactcctatataagcagtgcccactttctgcatcttgatattttgcccatttgtttaatgttctttttaatgaccaacacattgacttctcactacttagttgacagtttctgctgatgtccaacctaatgaaggcagtaacacacgttcacttaggatctggccatatggcaattcgctttaaacaatagtgttcaggaagaaatatattgtatgtataaaagtagggactgcttatttcttaggattcctcataaactgtgggctatagatcttaaaaggcagggatcgaggaaggataatgtcaaattctgccataacacaaacctctataagagatatctcagaattccagtctatccagtggcctacttatttcacacagttccaattttacagaagaatatagctactcttttggagtaaaagtaaaaatcttcgatttgcctttccaccagtccagtatccagaatgttatatattaataaattagtgaattctgttgcagagatagggagaaaggaagaggaactgctttagagtcagaatgataatttcaagaaaaactttgtcagaagacgttgctaaccattaaagagacgtacctgtggctgggcatggtggctttcgcctgtagtcctagctactggggaagctgaggtaggaggatcgcttgagcccaggagtttgaggttgcagtgagttatgattgcagcacggcactccagcctgggcagcagagtgaggaccctgtctcaaaaaaaaaaa

SEQ ID NO: 8622 - DNA, 673 bp, Homo sapiens
cttgtttccttttagtattttcctagcctgtggtaggtaggttgaaatagatatataacattgactttttctattacgtggaagctgttcagataattaacaaaggaaatcaatgacacacaactcagtttaagtgttgttttttctttagggtatgttgtgcagaagaaagagagctagcctaagagcattggacttttgggagctgtccagactcccccgccccccagaaccctgctgaagcccacctgcctagtccagtgaataaaaaaagtgcatgtctcacttcttttcagtgtccttcagagatgtgccattattactattttcttgacacattctgtgaattactagatcagggcaacaatattggaaacattaaatattcaaaatacaatctaaaatagatatgtactgctggcaaatgggattcatccatcaaaatttccttttgaattccattcctttacaataggttgagttgactgtggaagctctccagctaaacttgaatgtggctttcttattaaacttacttattttttcattttcttttcaaaatgtcacctattttgagttatttcttaggaggaaaacacccatgcacatacagatttttttccagcatctgtttcctgttgatcttacagtaatatcaaagaacagttgatcc

SEQ ID NO: 8623 - DNA, 489 bp, Homo sapiens
tgacacaaaaagaaacacattggtgcagatctatgaaagcatacctgaaatggttaagaaggtatgggattagagttaggaagccatacaaagttaggctagaggaagagcagtggctatgatcaacaattataaattcatggaggattccttttggtaaacaaaactcctatcatcctagaacttgaaagacaaaaggaagataaagtagtttgttcccacatatcagaaatgcaggctaaaagccaaataacttgaataatagcctaactaaatgtatagataacattgtggagaaaacacactttaggaattttaaaaatcttttgtgtgtccaggcgcggtggctcacgcctataatcccagcactttgggaggctgaggcgggcggatcacaaggtcaggagatcgagaccatcctggctaacatggtgaaactccgtctctactaaaaatacaaaaattagctgggcgtggtgatgggcatct

SEQ ID NO: 8624 - DNA, 271 bp, Homo sapiens
cttttcagtctttatttgattggccccatctgcattatttcatactggttgcaattgtcccttctttctttggggaccacacattcctggtccttttccttcttcctgatgattccttcttagtcaattttgttggtccttttatcagcttacagcctttgtattcctaaatgttctattctttgattactatttcttttatttacatgttcttcctgtcgtagttcatccactcccatggctttaggagcatgattccaaatcttagttt

SEQ ID NO: 8625 - DNA, 651 bp, Homo sapiens
gtcagctggggcctggtcagaggctgacttcagcaacatgatgtcaacacactatccagcccccaggcaccaagtcaccacatggtcctgtccccaagccattgtgtcaccacacggtcctgtccctgggccaccgtgtcaccacatggtccttttctctggccatcatgtcaccacacaatcttattcctgggtcaccatgtcactatatggtcctgtccccaagccatcatgtgaccatgtggtcctatcctcagggctaccatgtcatcatgcggtcctgtccccaggccatcatgccaccctgtggtcatgtccttaggggtaactatattaccacatgatcctttcccctgggccactatgtcaccactttcctgtccctgggccaccgtgtcaccatgtggtcaggtccttagagtcactgtaccaccacatagtcctgtccctgggccattatgtcaccacacggtcctgtccctagggccactatgtcaccacacggtcctgtccctggatcaccacgtcaccgcatgatcctgtccttagggccaccatgtcaccacatggtcctgtccttggggccactatgtcaccacactgttctgttcctgaggccaccacatcaccacacagtcctatccccaggcc

SEQ ID NO: 8626 - DNA, 417 bp, Homo sapiens
tgtcctatctttagtctaatcaactttagttcttctatgttctttattctcagcctaaatcctgccttcaaagaagcctcccctaactacctggcccatatgaactgtgccttttctgattttctaccacacacacatagacgctactcacatggctcctcttgtaccctgactccaacactcctttatgcctgttgcggtctacaatcgaatgacaacttttcattgtcctcacatctctcatcttccctctgtacctggtgtaagtgacctccatggttgatcattagaatcattcctttgactatattttcaactcttgcttataatacgtgcttaacaaaaccctgatccaagcagtttcaactttctgcctatggtgcaaccgcctttacatagctgagcatgactgactga

SEQ ID NO: 8627 - DNA, 420 bp, Homo sapiens
cagttaacagcagtacagacaaaacttaatgaacccataaaatagaatgtggcaattcacattgaaatgatggaagttctggatgaaatacacagaaaacataggcaaggaaaatagtcaaaggttttcaaaactggaagtggaaacaaagatctcagccagactgttaagaaagtgtatagagtgcctctcagcataatgttcaaagatagacatccacttgtcaatgtcttaatcacagagtaaaaatttattttagaaaaataaaacgacaactttactcagatgttatagaaaagatgccaggtgcggtggctcacgcctgtaatcccagctctttaggaggccgaggaggatggatcacgaggtcaggaggtcaagaccagcctggccaagatggtgaaaccctgtctctactag

SEQ ID NO: 8628 - DNA, 434 bp, Homo sapiens
  misc_feature (374)..(374): n is a, c, g, or t
cagttaacagcagtacagacaaaacttaatgaacccataaaatagaatgtggcaattcacattgaaatgatggaagttctggatgaaatacacagaaaacataggcaaggaaaatagtcaaaggttttcaaaactggaagtggaaacaaagatctcagccagactgttaagaaagtgtatagagtgcctctcagcataatgttcaaagatagacatccacttgtcaatgtcttaatcacagagtaaaaatttattttagaaaaataaaacgacaactttactcagatgttatagaaaagatgccaggtgcggtggctcacgcctgtaatcccagctctttaggaggccgaggaggatggcgtgagcccgggagncggagcttgcggtgagccgagattgcgccactgcagtccgcagtccggcctgggcgacgg

SEQ ID NO: 8629 - DNA, 595 bp, Homo sapiens
tagttgaaaggaaagagaaatctaacctgacaagacactttttaaagtttgccttaagcttttaagttctttataattttcttaatgtgatacataaaatacacaaggactcaaacaaatgtatctctttgagcaccagaaaaagaaaaagaattacattttaaagttcaatgaaaaaacagaaaacaggtcagttgatactattagccagttttatctcaaggaagtgtgctatagaggagcggatgtgtcgattaaaattagtacaatggctcataaaattatcaacaatcattatattttccatagataggataaaagatactgattctttacgctatcagggtatgtgatacttaaggtaacaacaacaaaaaagccaaatctgagaaagtatgtgagatcttactacatatcttggcttatattgcagattcccatcagaattttctattttaaaataaaacgtagagggagtcgttgttttcccttttacactttgctgtgtttcagcaaccctacagaataaatgggagttttataagaaaggaatcattcatacatgaaaagattatagatgacagaatttcataac

SEQ ID NO: 8630 - DNA, 356 bp, Homo sapiens
tccagttgcttttgctatataacaatcccaaacttagtgccataaaaaaaccaaccatttttttatggtcacagtttctgtgggtcaggcattcagaaagggcacagcagcttttctgtcttccatggtgtctgaggtcttagctggaggaccgaaagatcctggaagattctatggctggcaactgcaatcaacagaagcctcgtttactcgcatacctgatggttgatgctggctgtcagctgagaactcagcttgggttatcatccagaacacctacatggacctctacatataactttgggcttacttacagcatgatggctgggttctagaagacagtggcccaagacaac

SEQ ID NO: 8631 - DNA, 495 bp, Homo sapiens
ggggttacggtgacagatcagaccccttcccagctcaggggctctgagttatagagacgatgattcagaatccatccctgaagttgtgtcataaaaatgtcctgaagcaataattccgagaaggcaggtggcagcttttggctatgccatgcaaagtgccacacccaggaaagagccatgtggcctagcccatgtggccaaacagccccggttccctcctgggacctcagcagcccagactcatgagcttgcctgccaagctgtgcaccagagggcgctgttgaaacacaccaggagcccaggtgacagacaggccatcctgttccccagccagcctcccaagcacagcgctccaggacccagaagagaaaccctgaaaagacagtgtgagccctgccacagacctgtgtgacagcagagctgtttggctgctgtatgagtgtcaccggccctgcatttttttcttttttaataaagacaaagtcttgctgtgtt

SEQ ID NO: 8632 - DNA, 393 bp, Homo sapiens
tcccatagcccaaattgtcataatattcaataatgatgatcccagaactttgggaggctaaggtgggaggatccctcaaactcctgacttcaagtgatccgcttgcctcagcctcccaaagtgctgggattacaggtgtgagccaccgcgtctggccaagcagttggttttaacgatagtattaacgtatacagattcacaacttaacacagtgtttttctttccatgtaatttggaaaaaatgtttgaattggccatctctcccctattccccctttaaactgatggagcggtcttgtctgttttttcaatcattattcacaggtcttttatttttccggaggagaaaatacacactcctcttgaaatatacacttttcttgaaatgtcaaa

SEQ ID NO: 8633 - DNA, 391 bp, Homo sapiens
tatttttgaatttaaagaaatgtccaccatgactattttttaataagcaaaagacaattaatacattttaaaagaataatagttcttattatgccacatataataataaatcccagttggatataagatctaagaaagccaaccaaaatcctttcaatcttgtataataatggaagaaaactagcatgacattctgtaatcccaaaagataaaagaataaaaaagattttcaacaatgattaatttggagataaaacacaaatgtgataaatgtaaaaagattctttagaacaaggtgatttttaatttacaaaaaaattattataacctgtcaaattggcattataaaactgcatttgtgggaaaagggccgttgccataatattggtga

SEQ ID NO: 8634 - DNA, 455 bp, Homo sapiens
gagataatcactttaaatttccacaaaaggacatgaaagaatgaagactgaatccactgcgtgaggccatcagatgtctcccataagcagatttcaaacactgtcataagtgagtggccctctaaggttcagacttctagtccacaacaatttccatttaggtaatgtataatttttccaacaggggcacaaaggcattactattagaaaatgcgttcctgggcacccctcctcaacattcaataaatacgaactcagtgacctcttatcaccgagcctcaaagctgaccatgagaagaggacatctagtataaacttccttcaggggtgaagctcccctctgtaacaccctttcccagaagctcttggttgaaccctacagtaccctggagctcatgagacagcttattccattgttagtagatctaattgtcaaaaagttctttttgtgtttc

SEQ ID NO: 8635 - DNA, 285 bp, Homo sapiens
tcatcatataaaagcagcattttatcctactaaacttattttatctttctgaatttatattttctcagtatcaagtcagtaagaacaatgacgagggttcctggtagcccatgtcacaccactgcaaatgagaaagagggtatccttcttcccagctgagacatcccaaaatccagccaccatatgcagagcataccatacaagtgtgtgacagatcactgccaacacaatgttctagtgaataagcctattctaatgaaaacaaaaatttggaatgggaagcta

SEQ ID NO: 8636 - DNA, 410 bp, Homo sapiens
ccccgtggacccaggcgaccctggttctaggcctgggtgcacctcaggcccgctaggtgtaccccaaagcaggcagaaggcccatgaggagaaggtgaggtttgagggaggagaggtgacgcacctgcggcagaaaaatacaaacgtgccgaggagaagcggggcctggttctcccacagacgaaagtgccttctcatcagcccctgcgctgggcctcctggaccctggcgaccctagttcaaggatcagaagagactccggcacgctagggtaccctaaggaagccagaaagcccatgaggggaaagtgagatttgagggaggagaggtgagtcacctgtggcagaaaaaaaaaatatatatatatatatatatcagcgcctctgagaagccgggcctgggtccccact

SEQ ID NO: 8637 - DNA, 443 bp, Homo sapiens
ccaaaattattgcttaagaacgctgtcaactaaaatatcaaacatttcagtgcaaaagcattaagtatatagaaacagggccctcttaaatgtgataatcccacattttttcagccttattcggagtattctccagctatttccactcaaagattaacactgtcaatgcctactaaatgtgcactttggaaggctaaggtgggcggatcacttgaggtcaggagttcaagaccagcctggtcaacatggtgaaaccccatctttaccacaaatacaaaaattagctgggagtggcagcaggcacctgtaatcccagctactcgagaggctaaggtaggagaattgcttgaacccaggaggcggaggttgcagtgagccgggatcacactactgcattccagcctgtgagacagagcaagaccccatctgggaaaaaaaaaaaa

SEQ ID NO: 8638 - DNA, 513 bp, Homo sapiens
actttgaccaatgtcgactttttttttttttaaagatagagtctcattctgtcacccaggctggaaggcagtggcacagtcttggctcactgcaacctccgcctcccaggttcatgaaattctcctgcctcagcctcctgagtagctgggattacaggcacacgccaccaggcccggctaatttttgcatttttgtagagatgaggtttcaccatgttggccaggctggtctcgaactcctcacctcaggtgatctgcccatctcagcctcccaaagtgctggcattacaagtgtgagccactgcacccagccctgaccagtgatttttaaggagaagtttgctgggcttccggtgatgaagaagttgtttttcattttccctcagctcctgctttggactctgcaatgtaaggccaggctccatgaggctagtggaaccattttggacccacaaggtgacaaggatcaggacaagggaacacacacagagtcgacgaacagagaaaaagcag

SEQ ID NO: 8639 - DNA, 679 bp, Homo sapiens
tcttgccctccatggcctcggcgggctctgcagctgcctggggctcactctccttcggggaccctcctcttcccttgccgcgccctcatccttcttgtctttgtccttggctttctcgtcgttcacattgtagcccttcttcttgctgagtttgcctgtcatcttggagtttggctctgggtgcctgtgcagcccctgggtgagcgcggtgcccccaagaggccagggtccctggcggtgtctagctcatgcctggccgctggcggaggctctctcctggctccatggcggaggccagagcgaggagccagttgtagtgctagctccgcctttgtcgcagctgccactactgccaccgggaaaacatttttcttaaaaaatgtgttcttatggccgggcgtggcggctcatgcctgttatctcagcactttgggaggccaaggcgggcggatcacgaggtcaggagaacaagaccatcctggctaacatggtgaaacctcgtctttactaaaaatacaaaaaatttgccagggtggtggcaggcgccagtagttcgacctactcaggaggctgaggcaggagaatggcgtgaacctgggaggccgagcttgcagtgagccgagattgcactactgcactccagcctgagcaacggagcgagactccatctcaaaaaaaa

SEQ ID NO: 8640 - DNA, 280 bp, Homo sapiens
taaaccaaaggtagtaacaagaattgaatctttaaaaagggggaggagaagcatttaatatctttaattctaaaatcacatggtttgttggcacagtgatgtcagtgatgtcagtgtagttgcatcattgcgttaggaggactacaggaattcattagccactcagacaatatgatttggagtttcactctggtcatcatctgaaaatggctacagtgttccagaccaaaaagtaagtgcctagtggaacctttagctattataagaaacatctttagca

SEQ ID NO: 8641 - DNA, 411 bp, Homo sapiens
cccattttaaatgccactacagtttataaccaacttttttatatttaaatgttcttttatttagtgaatattcataagatggatacaattttataccatatgccttttccacattgctaacattgtttttcattgagttcttgtatttaacaaagcaatgcatatagatagttttaacaggttaatagtacagcaagcttgataaagaaaaacaagtattctctcccatctccttgctcctaatttcccactctacagagacaatcactttcaagtcctttagtatttacccccatatcagtacattacatgcttaactggatgtatatttatttactttttttttttttttttgagacacagtcttactcttgtcacccaggttggagtgcagtgtcacaatcttggctc

SEQ ID NO: 8642 - DNA, 340 bp, Homo sapiens
tagcaaagtttcatatcctttattcaccaaaacaaacgtaattgttgataggagcagcagagaagaaatatgcccaatatctgggacccttagtggtctagaaaagctgtgagagcaaacttctgaaaaatgatgcctattttgacccagttgtgccagtatttatttcttgcattggccttaggatgtttatctcacacagatgatgataagctgtttaccacgcaagaacaagcactgaatacaccagttggcatggagtcagagactactatgtatctccttatatttcattgccttatttcataagttatgtgaaaaaataaaggtaaatacaaat

SEQ ID NO: 8643 - DNA, 1948 bp, Homo sapiens
ccccaccccgcctccaaagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggttgagatccgtagcattttagtgtccgagaggataattgctaagggagcagagacctcttcacaccttcatgcgcttagacctgcctagaggctcagatggctcagtggcactgctcacagagaacacaggctggaggacatggagtcggggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccactgct

SEQ ID NO: 8644 - DNA, 1796 bp, Homo sapiens
ccccaccccgcctccaaagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacagactgtggctacacaatctctcaagtgagatcaatgaagattctgaagcgatttggtggcccagctggtctatggaccaaggatccactggggcaaacagagaagatctacgtgttagatgggacacagaatgacacagcctttgtcttcccaaggctgcgtgacttcacccttgccatggctgcccggaaagcttcccgagtccgggtgcccttcccctgggtaggcacagggcagctggtatatggtggctttctttattttgctcggaggcctcctggaagacctggtggaggtggtgagatggagaacactttgcagctaatcaaattccacctggcaaaccgaacagtggtggacagctcagtattcccagcagaggggctgatccccccctacggcttgacagcagacacctacatcgacctggcagctgatgaggaaggtctttgggctgtctatgccacccgggaggatgacaggcacttgtgtctggccaagttagatccacagacactggacacagagcagcagtgggacacaccatgtcccagagagaatgctgaggctgcctttgtcatctgtgggaccctctatgtcgtctataacacccgtcctgccagtcgggcccgcatccagtgctcctttgatgccagcggcaccctgacccctgaacgggcagcactcccttattttccccgcagatatggtgcccatgccagcctccgctataacccccgagaacgccagctctatgcctgggatgatggctaccagattgtctataagctggagatgaggaagaaagaggaggaggtttgaggagctagccttgttttttgcatctttctcactcccatacatttatattatatccccactaaatttcttgttcctcattcttcaaatgtgggccagttgtggctcaaatcctctatatttttagccaatggcaatcaaattctttcagctcctttgtttcatacggaactccagatcctgagtaatccttttagagcccgaagagtcaaaaccctcaatgttccctcctgctctcctgccccatgtcaacaaatttcaggctaaggatgccccagacccagggctctaaccttgtatgcgggcaggcccagggagcaggcagcagtgttcttcccctcagagtgacttggggagggagaaataggaggagacgtccagctctgtcctctcttcctcactcctcccttcagtgtcctgaggaacaggactttctccacattgttttgtattgcaacattttgcattaaaaggaaaatccactgct

SEQ ID NO: 8645 - DNA, 348 bp, Homo sapiens
ccgagttgggcctctccctgcctgggagttgtaaccctgcagcctccctcctgatcccccatcccttcaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatat

SEQ ID NO: 8646 - DNA, 2512 bp, Homo sapiens
agcggagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtga

SEQ ID NO: 8647 - DNA, 1193 bp, Homo sapiens
tattaccttgaagttttgagttaaaagaactcacaattttagtttaataattctaatttgagcaattgaacaaactgaactgataaccagcaaatttgtcactggtaccttccattttacagtgtcattgtctttatatagtggtctgtgagctgcccatggaagtcgattatttcaggtagtcaccacgtaagtgactgtcattcaatgcagtgatttcatgagtgcaatatttcttagtgtagacgaactttacagtgataatcactaggagaatgttcacaattaggtaaaacattcatgaaagagtgctcccccactctgtttgcttttagatttaaatgatgggggtagtatctcgcttctgtttcatgtcacgctggtattgaagagagcagaaaagagattatcttttgtttgataccttaagaatgatgcagaacatatgcttaatgtccatgttttaagaataatctgaagcagtgtagcacaaaaatggtctattatttcaggcctaatattttttaatatgtatttctatttgtgaaatattatttaaggacattgctttaaaattattcagtattagactgtcttctctgacttagtagagatctttttaatttcctccgcagcactgaacaattgaaaatatgtataatattcctaactttttttgcaagactttatttttctgatatgttattgtacaatatttaattctaaatttatttcaatttctcccccttcagtttaatgagtggtgttaagaataatgttggaagagggatcaatgttgccttggcaaatggaaaaacaggagaagtattagacactaaatattttgacatgtggggaggaggtaagcataaataacatgactgtgttcttttgctggcactgacttaatcacctcaatacaatgtagcccattaatgagagaatgatgatgctatttgcgttagttcattttgtttcccttactttctgttcactaaatgtccagctgtatttaagttatcattcatgttttatatactttcttcttcttagaaaaaaatttttgtggtgtataattgaagatagtaatatcaaaattgagatttttttaaaaaaagtcatcttgttttctacaggacaaccaattcaaaagttttgggctcctttaagtgtgtctaaaatttaaaaaaaaa

SEQ ID NO: 8648 - DNA, 517 bp, Homo sapiens
actcaatctaaggaggaatgtttgctctagagctaatgatatttgctttttgttttgattttttaggagcatattaatgaaaagtgccataaactgaaaaaccaaacatgagggtagcagaagatatttaatttagtagaagtaattgtactttttgtgtaacctgtttgttaaagaataactaaaggagaggttaaataatctttatattgagaaggttaaactgaaataaactaaatcattcagccctttgtttttaggtagttggcaaatcacaaattggacatttagtcagtatcacataaatttttttttttgttcaagtcttttgttgaaattacacattgagcttcttaaatctgaagatctgaaatgctccaaaatctaaaactttatgagcagcaacacatgatgctcaaaggaaatgctcatttgagtatttaggtttcagattttcagatttgggaagttcagctggtaagtatgatgcaaatattctaaaatctgaaaaaaaaaa

SEQ ID NO: 8649 - DNA, 411 bp, Homo sapiens
  misc_feature (20)..(20): n is a, c, g, or t
  misc_feature (31)..(31): n is a, c, g, or t
tcagcacatttagtccaacntgagggtagcnggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaccggagaagtattagacccataaatgtgctgaagggatcctctagaacagcatcgcg

SEQ ID NO: 8650 - DNA, 537 bp, Homo sapiens
  misc_feature (102)..(102): n is a, c, g, or t
  misc_feature (309)..(309): n is a, c, g, or t
  misc_feature (312)..(312): n is a, c, g, or t
cttcaatccttctgtctctcgaggaactaggctccaacacggggatccaggttttcaatccagattgtgaagtcgaggcctcatgaccaacatcgtgatctnttccccatgggattgcgtcgggtcctggggatgcttcagcttgggggccggacggcaggaccaagaagcagctcgccatggtgatgagatacggcgtaaatggagttggtaaaatattaaagaagatcaacaaggccatcggtctccaagaagaataaagacattgtgacgaggtgtaacgccggtgtttgttaagaatgcctctgnaantgaagtgccttttgttactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggcta

SEQ ID NO: 8651 - DNA, 558 bp, Homo sapiens
tcatcttgggcctgtgttatctgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacaggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcactctacctggatgatagagcaagactctgtctcaaaaaaaaaaaagagagagatacacaggcccaagatgaa

SEQ ID NO: 8652 - DNA, 2568 bp, Homo sapiens
agcggagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcacggcggagaggcgggcgggaggccggagcatattaatgaaaagtgccataaactgaaaaaccaaacatgagggtagcaggacagggaaaagttatctctggttgcatgtgcctatgattgctagaaaataagatggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtga

SEQ ID NO: 8653 - DNA, 2773 bp, Homo sapiens
tattaccttgaagttttgagttaaaagaactcacaattttagtttaataattctaatttgagcaattgaacaaactgaactgataaccagcaaatttgtcactggtaccttccattttacagtgtcattgtctttatatagtggtctgtgagctgcccatggaagtcgattatttcaggtagtcaccacgtaagtgactgtcattcaatgcagtgatttcatgagtgcaatatttcttagtgtagacgaactttacagtgataatcactaggagaatgttcacaattaggtaaaacattcatgaaagagtgctcccccactctgtttgcttttagatttaaatgatgggggtagtatctcgcttctgtttcatgtcacgctggtattgaagagagcagaaaagagattatcttttgtttgataccttaagaatgatgcagaacatatgcttaatgtccatgttttaagaataatctgaagcagtgtagcacaaaaatggtctattatttcaggcctaatattttttaatatgtatttctatttgtgaaatattatttaaggacattgctttaaaattattcagtattagactgtcttctctgacttagtagagatctttttaatttcctccgcagcactgaacaattgaaaatatgtataatattcctaactttttttgcaagactttatttttctgatatgttattgtacaatatttaattctaaatttatttcaatttctcccccttcagtttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtga

SEQ ID NO: 8654 - DNA, 3118 bp, Homo sapiens
agcggagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtgaatttttttttttttttgtattatctggcaaagtaatatacctacagaacttcacaaaaactcacacaaggtttttcaagcatttattatactgcctaacttggaaaaaaaattgttgctgtggttaaaaatagtaatatcctagatgtgtcttaacatgtaagaagctaagtatctagatggcggaaaaagcccttttattaagactgtaaaaggatagcttttccagatatataaaatgttaaaagaagacaaagattggttatgttaactggtgtggtttccttttgtctcagttcaatcttgtatagattgtgccaacttaactttgaaagcaataactttatactacattttcagatacctctttaaaatcggttttagacatgaaacagtgctcatttaatattaagaatgttctttattaaaatcaaattaacattgacatagtatttgaaatggtgcttatgggcttatcgatgcatattttttatttgtaatccgatgctgtcccagaataagtgtattgtaatgtgaatgttaaaattgaacaagagaaagcaggaaaataagtggtatttgggaaattaaaggaagattgaaccag

SEQ ID NO: 8655 - DNA, 2315 bp, Homo sapiens
agcggagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgttta

SEQ ID NO: 8656 - DNA, 1733 bp, Homo sapiens
tgatcggccggtcccctagttagaagttcaatagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtga

SEQ ID NO: 8657 - DNA, 1756 bp, Homo sapiens
  misc_feature (43)..(43): n is a, c, g, or t
  misc_feature (61)..(61): n is a, c, g, or t
  misc_feature (63)..(63): n is a, c, g, or t
tggccgggcctggccctggcaccgcccgcgcccctgtctttancacggctggtgcggggcnanaagccacatttggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtga

SEQ ID NO: 8658 - DNA, 1100 bp, Homo sapiens
gccctacctaacattgacgtgaagatggggagagcctttgactccaccatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtga

SEQ ID NO: 8659 - DNA, 1137 bp, Homo sapiens
tcttttccttaccttcccaaggaagtgaggaacgtgtaatatgaagacattgatcgtatatgtgacctagcaccaatcctgttcttaatgtagctagcatgtgagaatacatgtcacatatataaatcgtcagcagtggcataacggaccatacgtgttgcagaaactcaagatgtgagctcatgagggatactaacatctgggtatctgtactaacgacgtgatgtcacaagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtga

SEQ ID NO: 8660 - DNA, 1355 bp, Homo sapiens
agcggagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggcta

SEQ ID NO: 8661 - DNA, 630 bp, Homo sapiens
agcggagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaagttgttaacattccttgagctgcattactttaatgtgtctgcttaaaagtctcaaggtatgtgtagaaatcgaa

SEQ ID NO: 8662 - DNA, 2377 bp, Homo sapiens
agcggagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcacggcggagaggcgggcgggaggccggagcatattaatgaaaagtgccataaactgaaaaaccaaacatgagggtagcagctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtga

SEQ ID NO: 8663 - DNA, 2474 bp, Homo sapiens
agcggagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctatgaaaatatcatggaataatagggattttagggtggatactttattttcttttatgtttctatatgttgcgttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagtttttta

SEQ ID NO: 8664 - DNA, 2138 bp, Homo sapiens
agcggagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcacggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtga

SEQ ID NO: 8665 - DNA, 3234 bp, Homo sapiens
  misc_feature (1)..(1): n is a, c, g, or t
  misc_feature (3)..(5): n is a, c, g, or t
  misc_feature (7)..(7): n is a, c, g, or t
  misc_feature (1277)..(1277): n is a, c, g, or t
  misc_feature (1362)..(1362): n is a, c, g, or t
ngnnngnggcccagaactccctgtaggaattgccaaggggagaaggaaggaagggtgtttctacagagatgacagaatgtggctagagtaggctttctcaaccttggtactgttgactcttggggtgggataattctttgttgtgggggcagtcctgtgtgtcgtaggatgccaagcagtgtccatggcttctactcactggataccagtagccccctcccttctccacaagtcatgacaatgacaaatgtctctaggctgagcatgctggctcatgcctgtaatcccagcactttgggaagctgaggaaggaggatcacttgagcccaggagttcaagaccagcctgagcaacacagtgagacctcatctctacaaaaataaaataaaattagccaggtgtgatggcgtgcacccataatcccagctactcgggaggctgaggtgggcggatcacttgagcctgcgaggtggaggctgcagtgagctgagattgtgccactgcgctagagcctgggggacagagcgagaccctgtctagaaaaaaataagtctccagacattgccaaatgtttttggaaggcagaatcacccgctgattgaaaactactgggcctttggagatggggagcatacgggcaagactggagagtggattgggagctgagtaggctgcagcgacaatgcaaagtgatggaaggggagaggcgggcctacagcaaggaagtccaccagcgcatcaacaagcaacttgaggagatccggcgcttggaggaggtacggggcgatctccaggtgcagatcagcgcagcccagaaccaggtcaagcggcttcgggacagtcagcggctggagaacatggaccgcctgctgaagggccgggcccaggtgcaggcggagatcgaggagctgcaggagcagaccagggccctggacaagcagatccaggagtgggagacgcggatctttacccacagtaagaatgtcaggtccccgggattcatcctggatcagaaggtcaagatcaggcgaaggatcaggatcctagaaaaccagttggacagggtcacctgtcactttgacaaccagctggtacggaatgcggccctgcgggaggagctggatctgctgcggatcgacaggaaccgctatctgaacgtggaccgcaagctgaagaaggagatccaccacctgcatcacctggtcagcacccttatcctctcctccacctctgcctacgccgtcagggaggaggcgaaggccaagatgggcttgctncgggagcgcgcggagaaagaggaggcccagagcgagatggaggcgcaggtcctgcagcggcagatcttgcacctggagcagctgnaccacttcctcaagctcaagaacaacgaccggcagccggatcccgatgtcctggagaagcgtgaaaagcaggccggggaggtggccgagggcgtctggaagacctcccaggagaggctggtgctttgctacgaggacgccctgaataaactgtcccagctgatgggggagagtgaccctgacctgttggtgcagaagtatctggagatcgaggagcgcaactttgctgagttcaacttcatcaacgagcagaacttggagctggagcatgtgcaggaagagatcaaggagatgcaggaggctttggtgagcgcacgtgccagcaaggatgaccagcatttgctgcaggagcagcagcagaaggtgttgcagcagcgcatggacaaggtgcactcggaggctgagcgccttgaggcccgcttccaggatgtgcggggacagctggagaagctcaaggctgatatccagctcctcttcaccaaggcccattgcgacagcagcatgatcgatgacctccttggggtcaagaccagcatgggagaccgggacatgggcctcttcctgagcctcattgagaagcggctggtggagctcctgacagtgcaggccttcctacatgcccagagcttcacctccctggccgacgctgccctcctagtgctgggccagagcctggaggaccttccgaagaagatggccccacttcagccccctgacactctagaagaccccccgggttttgaggccagcgatgactaccccatgagcagggaggagctgctgagccaagtggagaagctggtggagctccaggagcaggcggaggcgcagcgccagaaggacctggccgccgccgccgcgaagctggacggcaccctgagcgtggacctggccagcacccagagggccggctccagtaccgtcctggtgcccaccaggcacccccatgccatccccgggtccattttgagccacaagactagcagagaccgtggctctcttggccacgtcacttttggcggcctcagctccagcactgggcatttgcccagccacatcacgcacggtgaccccaacactggccacgtgaccttcggctccaccagtgcctcgagtgggggccacgtgaccttcagacccgtcagcgccagcagctacctgggctccactggatacgtggggtccagcaggggcggagaaaacacagagggtggtgtggagagcggaggcacagcgtctgattcgagcggaggcctcgggtccagcagagaccacgtctccagcaccggccctgcctccagcactggcccgggctcctccaccagcaaagactcccggggctaacacgaggggcacgcagcccccaccctgccctggctctctgtggggtctttttttgtgtctctacttcccctgtttgccttgtgggtctctgtctttttctcccagtggcaggcctctgtctttttgccccttcaactgttttcatctgcccttcatcaccgcctcacctgtgtctcccggttcctttctctctgctcctgacactgcttttccctctgactcctgatctcctgttctctgggcttcctggtcagtgtctgtccgtcttgtctccatatctgccccttccctgtctgctgagccctggccccctgtggatcccccacctcctgtttccggctctctctcctcatctccatctcccaggctctccacgcatcctgtgtccctgtctctgtagctccttactccccaagagccccccagtgctgacaggtgtgggaaaagtcagggcgaagacgccaggttcagcatgggaaaatgggactgtggaaataaagtatatgtgtggagagccggcttcagccat

SEQ ID NO: 8666 - DNA, 3305 bp, Homo sapiens
  misc_feature (1)..(1): n is a, c, g, or t
  misc_feature (3)..(5): n is a, c, g, or t
  misc_feature (7)..(7): n is a, c, g, or t
  misc_feature (1277)..(1277): n is a, c, g, or t
  misc_feature (1362)..(1362): n is a, c, g, or t
ngnnngnggcccagaactccctgtaggaattgccaaggggagaaggaaggaagggtgtttctacagagatgacagaatgtggctagagtaggctttctcaaccttggtactgttgactcttggggtgggataattctttgttgtgggggcagtcctgtgtgtcgtaggatgccaagcagtgtccatggcttctactcactggataccagtagccccctcccttctccacaagtcatgacaatgacaaatgtctctaggctgagcatgctggctcatgcctgtaatcccagcactttgggaagctgaggaaggaggatcacttgagcccaggagttcaagaccagcctgagcaacacagtgagacctcatctctacaaaaataaaataaaattagccaggtgtgatggcgtgcacccataatcccagctactcgggaggctgaggtgggcggatcacttgagcctgcgaggtggaggctgcagtgagctgagattgtgccactgcgctagagcctgggggacagagcgagaccctgtctagaaaaaaataagtctccagacattgccaaatgtttttggaaggcagaatcacccgctgattgaaaactactgggcctttggagatggggagcatacgggcaagactggagagtggattgggagctgagtaggctgcagcgacaatgcaaagtgatggaaggggagaggcgggcctacagcaaggaagtccaccagcgcatcaacaagcaacttgaggagatccggcgcttggaggaggtacggggcgatctccaggtgcagatcagcgcagcccagaaccaggtcaagcggcttcgggacagtcagcggctggagaacatggaccgcctgctgaagggccgggcccaggtgcaggcggagatcgaggagctgcaggagcagaccagggccctggacaagcagatccaggagtgggagacgcggatctttacccacagtaagaatgtcaggtccccgggattcatcctggatcagaaggtcaagatcaggcgaaggatcaggatcctagaaaaccagttggacagggtcacctgtcactttgacaaccagctggtacggaatgcggccctgcgggaggagctggatctgctgcggatcgacaggaaccgctatctgaacgtggaccgcaagctgaagaaggagatccaccacctgcatcacctggtcagcacccttatcctctcctccacctctgcctacgccgtcagggaggaggcgaaggccaagatgggcttgctncgggagcgcgcggagaaagaggaggcccagagcgagatggaggcgcaggtcctgcagcggcagatcttgcacctggagcagctgnaccacttcctcaagctcaagaacaacgaccggcagccggatcccgatgtcctggagaagcgtgaaaagcaggccggggaggtggccgagggcgtctggaagacctcccaggagaggctggtgctttgctacgaggacgccctgaataaactgtcccagctgatgggggagagtgaccctgacctgttggtgcagaagtatctggagatcgaggagcgcaactttgctgagttcaacttcatcaacgagcagaacttggagctggagcatgtgcaggaagagatcaaggagatgcaggaggctttggtgagcgcacgtgccagcaaggatgaccagcatttgctgcaggagcagcagcagaaggtgttgcagcagcgcatggacaaggtgcactcggaggctgagcgccttgaggcccgcttccaggatgtgcggggacagctggagaagctcaaggctgatatccagctcctcttcaccaaggcccattgcgacagcagcatgatcgatgacctccttggggtcaagaccagcatgggagaccgggacatgggcctcttcctgagcctcattgagaagcggctggtggagctcctgacagtgcaggccttcctacatgcccagagcttcacctccctggccgacgctgccctcctagtgctgggccagagcctggaggaccttccgaagaagatggccccacttcagccccctgacactctagaagaccccccgggttttgaggccagcgatgactaccccatgagcagggaggagctgctgagccaagtggagaagctggtgagagtggggcctgcgggggtggggccaggcctcagtgtgtgtcggggcccagttcaccttccctgcaggtggagctccaggagcaggcggaggcgcagcgccagaaggacctggccgccgccgccgcgaagctggacggcaccctgagcgtggacctggccagcacccagagggccggctccagtaccgtcctggtgcccaccaggcacccccatgccatccccgggtccattttgagccacaagactagcagagaccgtggctctcttggccacgtcacttttggcggcctcagctccagcactgggcatttgcccagccacatcacgcacggtgaccccaacactggccacgtgaccttcggctccaccagtgcctcgagtgggggccacgtgaccttcagacccgtcagcgccagcagctacctgggctccactggatacgtggggtccagcaggggcggagaaaacacagagggtggtgtggagagcggaggcacagcgtctgattcgagcggaggcctcgggtccagcagagaccacgtctccagcaccggccctgcctccagcactggcccgggctcctccaccagcaaagactcccggggctaacacgaggggcacgcagcccccaccctgccctggctctctgtggggtctttttttgtgtctctacttcccctgtttgccttgtgggtctctgtctttttctcccagtggcaggcctctgtctttttgccccttcaactgttttcatctgcccttcatcaccgcctcacctgtgtctcccggttcctttctctctgctcctgacactgcttttccctctgactcctgatctcctgttctctgggcttcctggtcagtgtctgtccgtcttgtctccatatctgccccttccctgtctgctgagccctggccccctgtggatcccccacctcctgtttccggctctctctcctcatctccatctcccaggctctccacgcatcctgtgtccctgtctctgtagctccttactccccaagagccccccagtgctgacaggtgtgggaaaagtcagggcgaagacgccaggttcagcatgggaaaatgggactgtggaaataaagtatatgtgtggagagccggcttcagccat

SEQ ID NO: 8667 - DNA, 2741 bp, Homo sapiens
  misc_feature (713)..(713): n is a, c, g, or t
  misc_feature (798)..(798): n is a, c, g, or t
caccctgtttggccaggatgcctttgggacgcttggcagggagcgcccgctccgaggagggaagcgaggcatttctggagggaatggtggattgggagctgagtaggctgcagcgacaatgcaaagtgatggaaggggagaggcgggcctacagcaaggaagtccaccagcgcatcaacaagcaacttgaggagatccggcgcttggaggaggtacggggcgatctccaggtgcagatcagcgcagcccagaaccaggtcaagcggcttcgggacagtcagcggctggagaacatggaccgcctgctgaagggccgggcccaggtgcaggcggagatcgaggagctgcaggagcagaccagggccctggacaagcagatccaggagtgggagacgcggatctttacccacagtaagaatgtcaggtccccgggattcatcctggatcagaaggtcaagatcaggcgaaggatcaggatcctagaaaaccagttggacagggtcacctgtcactttgacaaccagctggtacggaatgcggccctgcgggaggagctggatctgctgcggatcgacaggaaccgctatctgaacgtggaccgcaagctgaagaaggagatccaccacctgcatcacctggtcagcacccttatcctctcctccacctctgcctacgccgtcagggaggaggcgaaggccaagatgggcttgctncgggagcgcgcggagaaagaggaggcccagagcgagatggaggcgcaggtcctgcagcggcagatcttgcacctggagcagctgnaccacttcctcaagctcaagaacaacgaccggcagccggatcccgatgtcctggagaagcgtgaaaagcaggccggggaggtggccgagggcgtctggaagacctcccaggagaggctggtgctttgctacgaggacgccctgaataaactgtcccagctgatgggggagagtgaccctgacctgttggtgcagaagtatctggagatcgaggagcgcaactttgctgagttcaacttcatcaacgagcagaacttggagctggagcatgtgcaggaagagatcaaggagatgcaggaggctttggtgagcgcacgtgccagcaaggatgaccagcatttgctgcaggagcagcagcagaaggtgttgcagcagcgcatggacaaggtgcactcggaggctgagcgccttgaggcccgcttccaggatgtgcggggacagctggagaagctcaaggctgatatccagctcctcttcaccaaggcccattgcgacagcagcatgatcgatgacctccttggggtcaagaccagcatgggagaccgggacatgggcctcttcctgagcctcattgagaagcggctggtggagctcctgacagtgcaggccttcctacatgcccagagcttcacctccctggccgacgctgccctcctagtgctgggccagagcctggaggaccttccgaagaagatggccccacttcagccccctgacactctagaagaccccccgggttttgaggccagcgatgactaccccatgagcagggaggagctgctgagccaagtggagaagctggtgagagtggggcctgcgggggtggggccaggcctcagtgtgtgtcggggcccagttcaccttccctgcaggtggagctccaggagcaggcggaggcgcagcgccagaaggacctggccgccgccgccgcgaagctggacggcaccctgagcgtggacctggccagcacccagagggccggctccagtaccgtcctggtgcccaccaggcacccccatgccatccccgggtccattttgagccacaagactagcagagaccgtggctctcttggccacgtcacttttggcggcctcagctccagcactgggcatttgcccagccacatcacgcacggtgaccccaacactggccacgtgaccttcggctccaccagtgcctcgagtgggggccacgtgaccttcagacccgtcagcgccagcagctacctgggctccactggatacgtggggtccagcaggggcggagaaaacacagagggtggtgtggagagcggaggcacagcgtctgattcgagcggaggcctcgggtccagcagagaccacgtctccagcaccggccctgcctccagcactggcccgggctcctccaccagcaaagactcccggggctaacacgaggggcacgcagcccccaccctgccctggctctctgtggggtctttttttgtgtctctacttcccctgtttgccttgtgggtctctgtctttttctcccagtggcaggcctctgtctttttgccccttcaactgttttcatctgcccttcatcaccgcctcacctgtgtctcccggttcctttctctctgctcctgacactgcttttccctctgactcctgatctcctgttctctgggcttcctggtcagtgtctgtccgtcttgtctccatatctgccccttccctgtctgctgagccctggccccctgtggatcccccacctcctgtttccggctctctctcctcatctccatctcccaggctctccacgcatcctgtgtccctgtctctgtagctccttactccccaagagccccccagtgctgacaggtgtgggaaaagtcagggcgaagacgccaggttcagcatgggaaaatgggactgtggaaataaagtatatgtgtggagagccggcttcagccat

SEQ ID NO: 8668 - DNA, 2140 bp, Homo sapiens
ctctgtttctctccttacccatatctaccgttctccccgcctgcatctccccatctcccttgctattgccgagtctctggctttccctctctgccttgctgtgtatttctgtgtcccacctgccgtatcttcccacacctctttgtctctgtgactcctctctgttcgtctctctgccttggtttctgtgtggccttcctcatcttcactttctttggccttctgtatgcctctctgtctctgttctctctgtctctgtttctctgtctccctctctctgggccccgccttgcccaactctcccagtcgaggagcgcaactttgctgagttcaacttcatcaacgagcagaacttggagctggagcatgtgcaggaagagatcaaggagatgcaggaggctttggtgagcgcacgtgccagcaaggatgaccagcatttgctgcaggagcagcagcagaaggtgttgcagcagcgcatggacaaggtgcactcggaggctgagcgccttgaggcccgcttccaggatgtgcggggacagctggagaagctcaaggctggctggagtgcaatggcatgatctcggctcactgcaacctccgcttcctgggttcaagcgattctcctgcctcagcctctccagtagctgggactacagatatccagctcctcttcaccaaggcccattgcgacagcagcatgatcgatgacctccttggggtcaagaccagcatgggagaccgggacatgggcctcttcctgagcctcattgagaagcggctggtggagctcctgacagtgcaggccttcctacatgcccagagcttcacctccctggccgacgctgccctcctagtgctgggccagagcctggaggaccttccgaagaagatggccccacttcagccccctgacactctagaagaccccccgggttttgaggccagcgatgactaccccatgagcagggaggagctgctgagccaagtggagaagctggtgagagtggggcctgcgggggtggggccaggcctcagtgtgtgtcggggcccagttcaccttccctgcaggtggagctccaggagcaggcggaggcgcagcgccagaaggacctggccgccgccgccgcgaagctggacggcaccctgagcgtggacctggccagcacccagagggccggctccagtaccgtcctggtgcccaccaggcacccccatgccatccccgggtccattttgagccacaagactagcagagaccgtggctctcttggccacgtcacttttggcggcctcagctccagcactgggcatttgcccagccacatcacgcacggtgaccccaacactggccacgtgaccttcggctccaccagtgcctcgagtgggggccacgtgaccttcagacccgtcagcgccagcagctacctgggctccactggatacgtggggtccagcaggggcggagaaaacacagagggtggtgtggagagcggaggcacagcgtctgattcgagcggaggcctcgggtccagcagagaccacgtctccagcaccggccctgcctccagcactggcccgggctcctccaccagcaaagactcccggggctaacacgaggggcacgcagcccccaccctgccctggctctctgtggggtctttttttgtgtctctacttcccctgtttgccttgtgggtctctgtctttttctcccagtggcaggcctctgtctttttgccccttcaactgttttcatctgcccttcatcaccgcctcacctgtgtctcccggttcctttctctctgctcctgacactgcttttccctctgactcctgatctcctgttctctgggcttcctggtcagtgtctgtccgtcttgtctccatatctgccccttccctgtctgctgagccctggccccctgtggatcccccacctcctgtttccggctctctctcctcatctccatctcccaggctctccacgcatcctgtgtccctgtctctgtagctccttactccccaagagccccccagtgctgacaggtgtgggaaaagtcagggcgaagacgccaggttcagcatgggaaaatgggactgtggaaataaagtatatgtgtggagagccggcttcagccat

SEQ ID NO: 8669 - DNA, 1623 bp, Homo sapiens
ctctgtttctctccttacccatatctaccgttctccccgcctgcatctccccatctcccttgctattgccgagtctctggctttccctctctgccttgctgtgtatttctgtgtcccacctgccgtatcttcccacacctctttgtctctgtgactcctctctgttcgtctctctgccttggtttctgtgtggccttcctcatcttcactttctttggccttctgtatgcctctctgtctctgttctctctgtctctgtttctctgtctccctctctctgggccccgccttgcccaactctcccagtcgaggagcgcaactttgctgagttcaacttcatcaacgagcagaacttggagctggagcatgtgcaggaagagatcaaggagatgcaggaggctttggtgagcgcacgtgccagcaaggatgaccagcatttgctgcaggagcagcagcagaaggtgttgcagcagcgcatggacaaggtgcactcggaggctgagcgccttgaggcccgcttccaggatgtgcggggacagctggagaagctcaaggctggctggagtgcaatggcatgatctcggctcactgcaacctccgcttcctgggttcaagcgattctcctgcctcagcctctccagtagctgggactacagatatccagctcctcttcaccaaggcccattgcgacagcagcatgatcgatgacctccttggggtcaagaccagcatgggagaccgggacatgggcctcttcctgagcctcattgagaagcggctggtggagctcctgacagtgcaggccttcctacatgcccagagcttcacctccctggccgacgctgccctcctagtgctgggccagagcctggaggaccttccgaagaagatggccccacttcagccccctgacactctagaagaccccccgggttttgaggccagcgatgactaccccatgagcagggaggagctgctgagccaagtggagaagctggtgagagtggggcctgcgggggtggggccaggcctcagtgtgtgtcggggcccagttcaccttccctgcaggtggagctccaggagcaggcggaggcgcagcgccagaaggacctggccgccgccgccgcgaagctggacggcaccctgagcgtggacctggccagcacccagagggccggctccagtaccgtcctggtgcccaccaggcacccccatgccatccccgggtccattttgagccacaagactagcagagaccgtggctctcttggccacgtcacttttggcggcctcagctccagcactgggcatttgcccagccacatcacgcacggtgaccccaacactggccacgtgaccttcggctccatatctgccccttccctgtctgctgagccctggccccctgtggatcccccacctcctgtttccggctctctctcctcatctccatctcccaggctctccacgcatcctgtgtccctgtctctgtagctccttactccccaagagccccccagtgctgacaggtgtgggaaaagtcagggcgaagacgccaggttcagcatgggaaaatgggactgtggaaataaagtatatgtgtggagagccggcttcagccat

SEQ ID NO: 8670 - DNA, 426 bp, Homo sapiens
gcaggaggctttggtgagcgcacgtgccagcaaggatgaccagcatttgctgcaggagcagcagcagaaggtgttgcagcagcgcatggacaaggtgcactcggaggctgagcgccttgaggcccgcttccaggatgtgcggggacagctggagaagctcaaggctggtgagcacccatgggcgccccctcccgagcctggcttctccacttggaaggacaccatcagcccgcggggcttggaggcattgcatggacaacctggttcacttgcttatcagttgccccatatctgtccatctttccaaccagggtctatccctccaactgtcccatgtccatctatccatccatcatctgtccctccaactgtcctacacccatccatccatccatctatcaatgcatccatccatccatctagggt

SEQ ID NO: 8671 - DNA, 270 bp, Homo sapiens
aaacgggaaaaatggataaatgtcacaaacagttcaagaagactttcaaatagtccctaaacacatacaaataatttagtcttactaaagaaatgcaaattaaagcaacaattagatacaatgtattttgtaacacatcgtggaaaatgtaaaaacagaagacacaatgctcaataccagccatggtataggagaccagtattctttttttctttttttgagatggagtccagcctgggtaacaagatggaaagtacatctcaaaaaaaa

SEQ ID NO: 8672 - DNA, 379 bp, Homo sapiens
cgagatctctgtgcagcctcgtgggaagccagcctaaaacctggaaaccttaacctccgtctcctgttgcttctcagtcaggactttcttggttgcaagtgatggaaaatcccacccatgctggcttagggaaggacaagggaggatttttctggctaaccaaggagtttttggggagtgttctgattcagctcagggaggaagtccatgtttacttcctcaaaggtggctgagggatgaggctcttcttgctggcccctgaggtcacaccagccctcagaagaaactgagaaactcctagtaattttcgctaaagaagatggttcaagggttgtgtgtgtttcctctgcctgctgtaataaattactacaaactaagt

SEQ ID NO: 8673 - DNA, 1674 bp, Homo sapiens
atgatttcatctactctcatgttttcaagcatcatttacatgctgatgacattccagtttgtatcgtcagcccagacctgtcccctgactttcagatgatatttcctagatgccccatagacatctcagatataacatgtcttctttccattggcagtaccagcaagccagacactccagctaggaactcaaggagtcagcctagaccccacatctcccaccctcagccaaccaagtcctggtggtttgattaggttggtgcaaaagtaattgtggtttttgccattacttctaatatattacttctttgcatttgctgttccagttgcaatgctctttccccagacatctgcatgttcttgtcctcacttgctttaggtctctctttcccttatcaaaaaggcttttgctgactatcctaaatacaatagcactccctcccaactattctttaatgctgtacctagctttatttttcttcagaatatttattactctttaacatagttatttctttattgtctatctccccactcccagaatgtaagcttcatgaaagcagagtctctgttctgttccctgttatatctccagcatctggaacagagcctgggacaagctaggtctccataactatttattggatagttgagtgactggttgtggatgtacagtataagcatctaattcaatcagggagtgcttcctggaggagctgatacctgtgttcagtcttaaagggcaggagtttggataggggaatgttagttaatagaatgaaaatttcaaaattaaagggcaggagtaattaattgggtggttgagatgcatgcctggcagagcaagcagagtatggaaaaacccagaagtggagatatctggaaggtgattggtatggctggagtagaggacactggcaggagagtagctggagatgaggcaggagaggaaggcaaggaccaggatcaggtttgaagggtcttgagcatcaggtgaaggcgttagactgatttgaagcaggaactggtcacttttgtgttaataggctatgtggaagagaagctggggtagggagacaggaagtagcaagcttcatgtttaaagaaccaaagagttctgctaacttaggaacccagagtaagttgaaaacaaattgctctctggctgaaagccttcagtggtgatagttggaaagtagaatgattgcagagatgtgctttggagatttggaaagcaggctgtgttatttgtggctgttttctccttgatgcatgtgcagaatttccatgaacgctaatggagctattctgagcatttgctgaagggaaggaagcttgcagacatccctcccaatcttgcccacacactgagaagtaactcggagctacagtctgttaaaaatgaaaaggttgaggccgggtgcattggttcatgcctgtaatcccagcgctttgggaggtcgaggcaggcagatcacctgaggtcaggagtttgaaaccagcctggccaacatggcgaaaccctgtctgtactaaaaatacaaaaattagccagatatgatggcaggcgcctgtaatcccagctacttggaaggctgaggtatgagaatcgcttgaacctgggagatggaggctgcagtaagccaagattgtaccactgcactccagcctgggc

SEQ ID NO: 8674 - DNA, 593 bp, Homo sapiens
agttttcttctctcccaactcccaaccaggaagccactgcagaacagcagccctgctcttcttgccaatgcccctgggtttggtgtctctcctctccctcctgcatcatcttgggtccaattctaagcacttatgtgtccccatcctagcagggagccatgtgaggtcaggacgaagtgtttggaaggtactgctgggaccctgcttgcatcccagggaccttgccatgtcaccgtgctctgctgtcttaaagatgccagcatctgcatcttgtgcctgggggatttttctggaatggtggaaggctgctctgcctatgtgcacagtgggagaaaggtgccagggagtgagcaccccccaggagcagctcctaaccagtgacccttggtatagaagcacccggctctactgctccttaggtgggattattctgaagtccacatttgaccccgtttcccagagtttcctaggggcagtcatccaccagggtaactggcctcatgccatactctatcagctgctttctttccctgaatcctgcctctactccctgctcaagcacctctccaataaactactggcactttcagagg

SEQ ID NO: 8675 - DNA, 440 bp, Homo sapiens
tgttttgtaaggttgttactaaaccttgttataggaggttgtaaaagacatattttaaaggtctaaaaatagaggaatggataaataaatgatacatttgtgcaatagaatatattaccataaaggtctagaatattaaataatatgaaaatgctgacagccatactaataagtaggaaactatagcacaaaacagtatgaagaatatgatttcatttttgttcccccaaatgggcacttatttacatgtaaacagctaaaggacaggaaaatatatttaacaagatgttaacaagtatggtggagttataggtaataaaaaaatttttttttgcttatttgtatttccttcaatgaacatgtattatttggttatgacgggaaagtaaaatgtttcttaaaaactagtctttattgtatcataaatagatgtcagaaat

SEQ ID NO: 8676 - DNA, 399 bp, Homo sapiens
ttttttctttatttttagtagacacagagttgcaccctgttggccaggatggtcttgatctcttgaccttatgatctgcctgcctcagcctcccacagtgctgggattacaggcgtgagccactgcgcccagccagaaatgtggtttcaccatgttgtccaggatggtcttgaactcctgggctccagtgatcctcccatcttggcctcccaaagtgctgcaattacaggactaagccaccacacctggcccctatactactttctgattgtctttattccttacttctccatgctttccccttccttaccttctctttctcatttgtttttctccttctagtgtgttcagatgaattctcctgaactaatgctgtcattatattatgagacttcacag

SEQ ID NO: 8677 - DNA, 503 bp, Homo sapiens
actatcaactgaggttgtcctcctccctgcaagatagagtggaggcctggattttagtggagagagggaaactttcctgtgttgttctgagtttaggaaactacacaggaaacaccttggactatattatgcttttgcttcttctgattttatctgatcattttcaaaatatcaataacagagctgtacttctaagaggtcaagtggtttggagttctataaagctataaggatgggcagaacctaggaaatgctgttagtaaaggagaaaaataaaatctaatggctagtaggaacaagggaattttagggaagatgagcttcccagttatattgagaggtccctttccacagtaagtagtagtttgatagagagattacatggctgggcatggtggctcatgcctataatctcagcactttgggaggctgagacaggcagatcgcttgagcccaggagcttgagaccagcctgggcaacatagcgagaccccgtcttttta

SEQ ID NO: 8678 - DNA, 307 bp, Homo sapiens
gcctgtaatcccagccacttgggaggctgaggcaggagaatcacttgaacctgggaggtggaggttgaagtgagctgagatcacgccactgcactccagcctggcgacagagcaaaactccttctcacaaaaaaataaaactagtgtgggggaggggggagggatagcattgggagatatacctaatgctagatgacaagttagtgggtgcagcgcaccagcatggcacatgtatacatatgtaactaacctgcacattgtgcacatataccctaaaacttaaagtataataataaataaataaaaa

SEQ ID NO: 8679 - DNA, 584 bp, Homo sapiens
cagcgtctcgctctgtcgcccaggctggagtgcagtggtgtgatttcagctcactgcaacctccacctcctgggttcaagagattctcctcctcagcctcccgggtagcggggattactggcgcatgccactacactcagccaatttttgtatttttagttcgagaccagcctggcccacaacatggtgaaaccccgtctccgctaaaaaactaaaaaaacaattagcctggcatggtggcaggcacctgtaagctactagggaagctgagatatgagaatcgcttgatcccagaaggcagaggttgcagtgagccaagattgcaccactgcactttagcctggacgacggagcatgactccgtctacaaaaaaaaaaaacaaaaaaacaagcaatttatagatatgattaaatgaaagctcttaaggagattatcctagattatccaatgagcctaaagtaatcacaagtccttacaaaagggaagaaagagggaagccacccagatttcaccctatatatctctcccttttgctgcttccaacatgtatcttttttgctataataaaactgtaagtccagca

SEQ ID NO: 8680 - DNA, 700 bp, Homo sapiens
tatttttcatgatattctgattcccgcacagggatcgcatggcatgaatgcttcttgccctggtcggtgctgccctagaatccttgtctgaagtgtggtgctctgtggttgtttttctgcctcccccagagttgaggctccaggcaactgtaatgcagagatgagaccagcacgttggctgccaatctgcccacgacatatctgcatggatcctctctgtccaccccaaggctgccgccgtggttctgagactcagcatgtcaccccgtaaatcctgtaaaagtcctgatggcagcctcctccaagccatcctgattgcgctatggggatgaatcttatcacaggctcggtcatttatcactcctgcccaaactttcagtggacagcggtggtgctgcccccactgggctggcctcattcctctctcaagggcactgtgctctctgctccctctaaccacacacagatggacctcatgtacaccttgtctatgtctcctcagccttggctcagtgtggccccacttcctccagcaccccctgagctctgccccaaatgatggcttcaaaatcagccgtccttcaagaccacatcccggaggctctcctccataaggagccattgaaccctgctctgcactctgcacacccaacactatggccagccccgcagaggcacctccttcttagggcctgagcgt

SEQ ID NO: 8681 - DNA, 571 bp, Homo sapiens
tggccttttgaccgcataggtaaagtcctgcttgctgctgttgacctgatgaagggcagcatgttggaacttccatctgttttacactcttttggcgggtcatttctcccactgtgagccaggcttgagaatctaggcagatgtcagaggtctgtccctatgtttctttcaagctggcaagaattccaccatgactgccacttgctcccccatgggtgtcagaatctgtcataatggttggatgtttttgtaaaacataaacattcctgattttaaggtgtacaatgagacacattttgtaatttgggaaggtacaccatttcagtttagcaatagggagctatggagttaggcagggagtcaatagaatatgtgcagtcttggcagtatttcagtgtcagttgatccttgattgttcacagtgatatataatgccttagtatttaatgagaaaaacagtagaaaaatttatgtggttcctcatcatcccccatgtcttataccttgcttgtccctatctttaaagtaacctccaaaacggatgaaaggttttatatttaaaaaaaaaaaa

SEQ ID NO: 8682 - DNA, 292 bp, Homo sapiens
gtagaatatattcgatccatagcccagaaacataaaaacaatattagcaaaagtttaatccaatgctaatgttcatttatttattatagacgtggggtcttgctatgttgcccaggtgggtcctgaactcttggcctcaagcagtcttcccgcttcagcctcctcaagtgttgagatgaaaggcatgagctgctgtgtccagcctatttatttatttttaatgacatagattttgttgtgtttcaactcccccaaatcctgtaacctgaataaacccctagattttaagatg

SEQ ID NO: 8683 - DNA, 2405 bp, Homo sapiens
ggcacgaggtcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctctgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaaaaaa

SEQ ID NO: 8684 - DNA, 2366 bp, Homo sapiens
ggcacgaggtcaaaagtggcgggtgtggcgcggggctggtagcggccggagccgtgcgagttctctaccctgcttcgcgagcgggcgagagaacgcgagtcccaggatccccggcacccagttctcttccactgcattcccccggcgcgtgtgggaccgaggtggacatggatccgcagaggtcccccctattggaagtaaaggggaacatagaactgaagagacctctgattaaggccccttcccagctgcctctctcaggaagcagactcaagaggaggcctgaccagatggaagatggcctggagcctgagaagaaacggacaagaggcctgggtgcaacgaccaaaattaccacatcccacccaagagttccatccctcactacagtgccacagacacaaggccagaccacagctcaaaaagtttccaagaagacaggaccccggtgttccacagctattgccacagggttgaagaaccagaagccagttcctgctgttcctgtccagaagtctggcacatcaggtgttcctcccatggcaggagggaagaaacccagcaaacgtccagcctgggacttaaagggtcagttatgtgacctaaatgcagaactaaaacggtgccgtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgcaggagggcttggtgcaagagcttcagaaaaaacaggtggaattgcaggaagaacggaggggactgatgtcccaactagaggagaaggagaggaggctgcagacatcagaagcagccctgtcaagcagccaagcagaggtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctctgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggtttttttttt

SEQ ID NO: 8685 - DNA, 1288 bp, Homo sapiens
cccacccaagagttccatccctcactacagtgccacagacacaaggccggagccgtgcgagttctctaccctgcttcgcgagcgggcgagagaacgcgagtcccaggatccccggcacccagttctcttccactgcatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctctgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaaaaaa

SEQ ID NO: 8686 - DNA, 567 bp, Homo sapiens
ctaaacctgcctccttacatgtttaagttgggcctaaatgtttctctgtacatcgtgaactataacaagtgaaggtgtgaccagacccgtagccgacacttgtgtcaatcaccaagttttggcccgtcaaatgtagccaactgttcaaactgtgttcaaataagaaacatcaatccataacaaatccggatgcttctgtacctcacttccattttctgtacatcaccttccttctactttccataaatcatctaccacatggctgtgtggagtctcagagcctattctggctcaggaggctgcccgattcacaaatccttcattgctgaattaaactcctttaaatttaattttttttcttttatcacccccaaaatatttcaacggaaataatttaaataatttttttagagacataaaaactatgttatcaggatcacttaacaagacatcactcaaaaagggacacaagtttaggtttttcaaccttttaatctctattgagagtggtttagaataacgaagtgaaagggattgaaaaaaataaaaaccttatcagtgctatat

SEQ ID NO: 8687 - DNA, 270 bp, Homo sapiens
caggccccttcgtcacccaaactaacatggccctaaaagcttccatgaaccatattaaatgtctccttaggatctcatggaaaagggggcatatgtggtcttaacagataatccctctatgtcatggcacaacataagacttggaaagaacaatttgttttttccaagtgtttctcttctaccaagaaaagaaaggacattggcatgttctggggagaaattctgaattcagattcagtcttgacaagcctccagctgaatgagttatcc

SEQ ID NO: 8688 - DNA, 448 bp, Homo sapiens
gattctcttcatttctccatgtagtttgcatacataaccagttagcgtaagttctatttaatatccttgccaacttatagagtgtaaatcttttggcttcattcactcattcactaaaacatctattgagtgtctactatgtgccacactagcacctacagtcaacagtcaccagcaagactctcattagactatctcttaaaatgcacagttgattctcattatgtgtggtagttacattttataaagttattgtgaacacgaaattagcaaatacttaacctttgctcctaggaaaaatacagggttaggttcctgcaagcctctggtcataacttttttgtcaactgatcaatgtacaaccttgttttatgtgtgtttctgtttaaagataacttatgtaatatatattgctgattcattaaactgatagctaataactataaaa

SEQ ID NO: 8689 - DNA, 394 bp, Homo sapiens
cttgtggtttacttagtaggagtgacaaaaacctcattaattatttgggaggcctggattctaaatccatctgtcactagctaccctcagaaaggttcactttttgaacctcagtctcttgaaatttaaaattggacttgacagtctctgtaatgttgcaaaatctgatttaattctaaatttctgtgtttatatgtttctaaaaatgaatgggttctgttttttcttttgtttggcctgtatttatattactgcaaagagaagagtttgatttagactgtttagaagcaacctctttttttccccacagtgtttttttatgttgtccagaaaagcagccacacaagttttgacttaaatatataggttttattaaaacaaaagctgttaaaac

SEQ ID NO: 8690 - DNA, 357 bp, Homo sapiens
ctcctctccccaggcactccccaggcctttagagaggacattctcccactctcttttatggaaagccatggaatcttctgtgtggatgcagcctgggcagtcagagaggggcctggccctcacgtggccgcagctgacccctccccgccgcagctctccagtctcctctgcgacgtgacagccctggcttctctgctgtggggaggagagtatttttagttttgaacccaccacgtgaagcgagacaagttatcaatagcagcagcaaagggctttttctttctctctctcttttttttttttcccatgtctttgggacctgaacaatctgcacccattaaattctgccaaaagaaa

SEQ ID NO: 8691 - DNA, 458 bp, Homo sapiens
  misc_feature (438)..(439): n is a, c, g, or t
aaaatggagttttgcacttcagcctgggagacaagagcaagactccatctttaaaaaaaaatgaaagaaagaataacaaaatgctcagtggttggctagattcactcactgatatgtgacttgttcccagacttcagctttgggaatttaattcccaaattaaaggctcacacacctataatcccagcactttgggaggccaaggcaggaggatcacttgaggccgggaagttcaagaccagccttggcaacacagtaggaacctatctctacaaaaaatgtttaaaaattttccaggctgcagtgagccatgatcatgctaccgcacttcagcttaggcgacatagtgagaccctgtctcaaaggaaaaagaaaactacaaatctttgcatgccataggggttctctaatggatgttatgctattgaacttctaaanntaggggccgagctcgatga

SEQ ID NO: 8692 - DNA, 304 bp, Homo sapiens
ttggttattatttgataatccgacatggccttgtaaataatccatttaacatgctattgaaacttctaaaactaggcctagttttagaagtttcaagaccagccttggcaacacagtaggaacctatctctacaaaaaatgtttaaaaattttccaggctgcagtgagccatgatcatgctaccgcacttcagcttaggcgacatagtgagaccctgtctcaaaggaaaaagaaaactacaaatctttgcatgccataggggttctctaatggatgttatgcttgtgaaacaaccggaggtaag

SEQ ID NO: 8693 - DNA, 675 bp, Homo sapiens
tggttcgcctcctcttctccttctccgtaggtgttaaacaggatccagtggagtcagatccccgtgtgacacgtgcttccctgtgacttttctctctgtatctccacgtttccggtgcacatgcctttactcagactccgacactggcgttgcttttgtctcatcccagctaggcgacgtctgcgtcagcgcctctcatctgtggcacgtgtgcccagcgggctccctatgtgacggcttttcccacctctgagtgttcatgtcactcgctgcatgttctgccacactcggcccctctgcagagcctctcacttgtttcaaaagaactttccatagtgacaagtgagggcgcagttagcctttggaaccctcgactcggctcctctgtcaccagcgttctctcccacccttctttcttggttttgaactacttactgttttaaaacaaaccccattttactactgaatagcacagtgtgtttctattaagatcaaaaatggaccattgtctcacataacagcaatgcttttcacatgtaacaaaaataacaatttcctgttattatttagtgcctagtccatggtcaaaggtctgttgacaaaatgccttttactttttttctctctttctaattggatccaaactggttccactcattaaatcaatctgctgca

SEQ ID NO: 8694 - DNA, 757 bp, Homo sapiens
gtctgtttttcatgggataatttttattgatctatatccaaattgaatttgaatatactttattcctatgtaatctcctttgtcctctcaaagacatttaatttttttttccaatactgtatttttccgtcctaaaatttccatttgtttcttttatagtttttattttattgctgagatacttctatcatgtctttcacctggaagaaaacaaatgtgtttttcttgagttcatggaacatatttaaactaaatgctttaaagtctttgtccaataattctcatacgtggatcatcttgagttgctggtttagctctgtgtccccaccaaaatctcatcttgaactgtactcccaggattcccacatgttgtgggagggacccagtgggagataactgaatcatgggggcagttttccccatactgttttcatgatagtgaatacatctcatgagatctgatggttttatcggggatttccacttttatcagggtttctcattctctctttgcctgctgccatccatgtaagatgggacttgctactcctagacttccaccatgattgtgaggcttctccagccacgtggaactgtaagtccaattaaacctctttcttttataaattgcccagtcttggggtatgtcttgtcttttttgttgttgttttttgagatgcagtttcactcttgttgcccagcctggagtgcaatggcatgatctcggctcaccacaacctctacctcccggattcaa

SEQ ID NO: 8695 - DNA, 1523 bp, Homo sapiens
gtctgtttttcatgggataatttttattgatctatatccaaattgaatttgaatatactttattcctatgtaatctcctttgtcctctcaaagacatttaatttttttttccaatactgtatttttccgtcctaaaatttccatttgtttcttttatagtttttattttattgctgagatacttctatcatgtctttcacctggaagaaaacaaatgtgtttttcttgagttcatggaacatatttaaactaaatgctttaaagtctttgtccaataattctcatacgtggatcatcttgagttgctggtttagctctgtgtccccaccaaaatctcatcttgaactgtactcccaggattcccacatgttgtgggagggacccagtgggagataactgaatcatgggggcagttttccccatactgttttcatgatagtgaatacatctcatgagatctgatggttttatcggggatttccacttttatcagggtttctcattctctctttgcctgctgccatccatgtaagatgggacttgctactcctagacttccaccatgattgtgaggcttctccagccacgtggaactaccaatacgccaaccagcaatgacccttctcaatcaaaatggcttctaatagggtccttccagtttgaaggcaaagtgtgccccattgtttaaatggtgatattgtaggaaactataccacaaacagaatcaagtgcatgaagcctgcttccgctttccctgccctgggacatcagactccaggttcaccagcctttggacttgcaccagcagcttcccggggaatctcaggacttcagccacagactgaaggctgccatgtcggcttccctggttttccggctttcaaactcggactgagccattactggcttctctctttccccagcttgcagatatcctatcataggacttcaccttgtaatcgtgtcagttaattctccctaactgactcccttttatatatacatatatcctactggttctgtctctttggagaagcctagtacatgccattttaaaaatgtacatgtgtgtacatgtatagttctgtgcaattttatcttgtgtatagattcatgtaactaccaccacaatcacaatatataactgttccattatcacaaaagaactccctcacactgactgcctctttgtatttctacttactcccccattcattttccccaggccctgtcccctggaaattattcatctgttctctatctctgtaattttgtcattcaagaatgttatataaatggaaacatacagtatgtaacattttgagatttaattcttctcacaaagcataacacccttgaggcccctccgggttattgtatatatcagaagttcattcctttttattgttcagtagtactccactgcatggatataccagttttgttaactattcacccactgaaggatacctgtgttgtttccggtattctgctattacaaataaagcctctatgaacacaca

SEQ ID NO: 8696 - DNA, 1478 bp, Homo sapiens
ctgtaatgctgttagaatcacctttcctgtatgctctcagaaataagtgccgcttttgcaaagtgttaagataatttaatgtctggcttttctgtttcatcatctcatggcatgaggaatgctgactgctctaaacgttgaacttctagaagcttgaacccattgacttgccacgagtaattacttcaggaagactcctgagccagcgagaagccaggacaatgcacaaagcaaagcaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccgggcaaacccacagttgaaatttccaatattgttcacacacacagatcgctgtgctgtgggccaaatccccacatcagcaggactgacccaccgctgagagagctgcagaaaagctggctatgtctctggaggtcttgaacttctaagacgcaaaattgcctgctgaaagagacactgctcctacttggagaaacaagacgctcgatcaataagttaattaaataagaaaaggctgaataattgaaaatctacttggggcatctatttaacctatacttccaagtctcagaatgaaatatcctttgtagtcacataaacaatttttaccatttaaaccgtaccttaaaaaatatacacaaaacaaccaagaaaaaaacctcacctaaagttagacatttaagagtcatcacttgagagcacgccaagaaaaaccagcattggcaaagtccctggaagatgtctcagacctggaggggaccaaggagaaactggcacatggagaaaggggttttcctctgctctcctgatgctttttaaagctgcttcgttttgttcaagctaaggtttgttgagtgcttactataagccaggtactgtggtttgcctttaatatgcattatctcttttaattctcacacaacctagaaggtaggagctactattcgccccagggtgatagagccagaattcaaggtcaggtcttcttgacttgcactctcacacagccccaccaggacaccaaggacttggaactctgtcaaggacagctttggaaaagtttgcaaatgtgggggttgtgagtccttgaccttatttacaaagaaggctgcactctgcgacttctgaaaggaaagttaaagcagctggcagactttggagctcatgttctcctggaagtgatggagtgtagagaagggagaatagaaggagtaactcaggcaggaaccaattcaagtgccagtcagggaggtgtagctgca

SEQ ID NO: 8697 - DNA, 3094 bp, Homo sapiens
cagagctagaaggatgccatgaaggaaatgactgctttgtaaagcgagggtaaacttctgaaatgctttgattaaaataagctatattaaagaccccaaaaccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactggtatggaagatattctacagcatccagagacatgtattttgacatcccactggaacacagagaaacaagtattattaaaaggcatccaccccaaagacttcaaaagcttgaacccattgacttgccacgagtaattacttcaggaagactcctgagccagcgagaagccaggacaatgcacaaagcaaagcaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccggaaattcaaagaatacagaatttttgaaacatcaagcagtgaataactgctgtccctggaaaattggcaaaatggaaacatggcttcatgaacaagaggcccagggacagcttctctgggacagttccagctctgactcagatgagcaggggaaagatgagaagaagccacgagcactggtgaggaccaggacagagagaatcccacttttcgatgagttttttgatcaagaataagaatactattcattaacctagaaactgagtgctttgaaagcttgttttactctcaaaatcttccaaactgatatatgaattactttgaggacagcaaatcactttggtaaaaagaaatgatatctttagagtcttatgattaacaagtccgtcacatgtgctgttaactattgctgcataactaaatgcctcaaaacacaggggctaaccaagagccattttattgtctcactttcctgtgggttgctgagttcagctaggtggttcttctgctgttcccttttgaaatctttcatgtcattgaaattggactacatttggactactaagactggagtcatccagaggccccattaggacactgacacagggggaccttgccccctatccatgtagcctcagagcatctgcatatgatctcttcagcaggacactgcagagatttctctcatatgagcccagggctcccaaaagcaattgtctcaagaggaggaaacagaagttgccagtcttcttaaaagctagtcatagaactgactttgcatcacttccaccatgttctgttggttaaagtcatagaccagcttggagttaatgcagaagaggactacacaagggcatgagtgccaaagtgtggtcctttggggttcatctttgacatttgccacctcaccatgtttttaaaaagaaaattagattacataaaacaaatagatgggctggatgtggtggctcacacctgtaatcccagcactttgggaggccgaggtgggcagatcacttgaggtcaggagttcaagaccagcctggccaacatggtgagacaccgtctctactaaaatacaaaaattagccagacatggtggcattcgtctgtaatcccagctacttgatgcgaaggctgaggcaaaagaattgcttgaacccaggagatagaggttgcaatgagccaagatcactccactgcactccagcctgggcgacagaatgagactctgtctcaaaattaaaaaacaaaaaaccaaaaacaaatagatgaaaaagtagactggagacaaataaaagtgagtttctaaaggaaattcacagtaatgctgcattaaacactaagctcacttaggtcactttctagtgagctaaccgtaacagagagcctacaggatacacgtgagataatgtcacgtgtagaagatcgttgtgaattaaagttcaaaattaagacttcttagattatgatgtagattttagagctccttaaaacataaagcgaatcttataaatgttcaattctaaagttattccacttggaaaaattagcttttgggacaatttttaagaacttttgtgtaaatgcagctccatgtttagcataatctaaaaataatttcaagcaatccagaatcttccaagaatttattaaagctttaaaacaaagcaaaacaaaaagacccttttgtgccttatatgggaagactccaaaaacagaaaaaaatagaggaaaacaccacttcaatttgacattcaatgcattcacatcagaaactaagaagataacaagcctgagatgtcaggtgataaaaattcatgtttcttccaaggacagaaggctattagattgtcccaggccatatctattcccagttctttgtgagtagtcttcttactttttctgtggtaggtaagaagcatatttccaccaaaagaaagcatgcattgtttgactagccagctttctagaaaaaatgagatccttgagaggataaacaaatccaacctattcatggtgtcctcacttattgtggtcaatttggaaggcttaaaacacaaaaaatgggatggataactttgaacactaaaattagtggagccaaaggcacgtcttcaccattctgttatgtgacttaaaattcaatttcacgaaacccacttccacaagcttaatgaactgtgagctacatgagggcataaaccatgtcttctttgtatggtattcctgcttcctagcaggacagctggcaaagagtttatcattaaatgtttgctgaattaatgaaaaaaaa

SEQ ID NO: 8698 - DNA, 1304 bp, Homo sapiens
ccactctcctgcctcagcctcccgagtagctgggactacaggcgcccgccaccatgcccggctaattttttgtatttttagtagagacgggggttcactgtgttagccaagatggtctcgatctcctgacctcgtgatccgcccgcctcggcctcccaaagtgctgggattacaggcgtgagccactgtgcccagcctgttttattttttaatatagctctgggcgacagaatgagactctgtctcaaaattaaaaaacaaaaaaccaaaaacaaatagatgaaaaagtagactggagacaaataaaagtgagtttctaaaggaaattcacagtaatgctgcattaaacactaagctcacttaggtcactttctagtgagctaaccgtaacagagagcctacaggatacacgtgagataatgtcacgtgtagaagatcgttgtgaattaaagttcaaaattaagacttcttagattatgatgtagattttagagctccttaaaacataaagcgaatcttataaatgttcaattctaaagttattccacttggaaaaattagcttttgggacaatttttaagaacttttgtgtaaatgcagctccatgtttagcataatctaaaaataatttcaagcaatccagaatcttccaagaatttattaaagctttaaaacaaagcaaaacaaaaagacccttttgtgccttatatgggaagactccaaaaacagaaaaaaatagaggaaaacaccacttcaatttgacattcaatgcattcacatcagaaactaagaagataacaagcctgagatgtcaggtgataaaaattcatgtttcttccaaggacagaaggctattagattgtcccaggccatatctattcccagttctttgtgagtagtcttcttactttttctgtggtaggtaagaagcatatttccaccaaaagaaagcatgcattgtttgactagccagctttctagaaaaaatgagatccttgagaggataaacaaatccaacctattcatggtgtcctcacttattgtggtcaatttggaaggcttaaaacacaaaaaatgggatggataactttgaacactaaaattagtggagccaaaggcacgtcttcaccattctgttatgtgacttaaaattcaatttcacgaaacccacttccacaagcttaatgaactgtgagctacatgagggcataaaccatgtcttctttgtatggtattcctgcttcctagcaggacagctggcaaagagtttatcattaaatgtttgctgaattaatgaaaaaaaa

SEQ ID NO: 8699 - DNA, 2939 bp, Homo sapiens
cagagctagaaggatgccatgaaggaaatgactgctttgtaaagcgagggtaaacttctgaaatgctttgattaaaataagctatattaaagaccccaaaaccacttccctcgcagctttcctctgaatgtctttcacatgaaatgggcctgagtcactctaagactcaccttagggtgatcaaagtagcacctttgcaaaacaaagaggtagagactccctcggctggccgtgtggactttgcattcaatcagaatttggaagaaaagacttcatattcactggcaagactgcaggaccagaataaagccttggaagggcagctgccacctttacaagaaaactgcatccagagacatgtattttgacatcccactggaacacagagaaacaagtattattaaaaggcatccaccccaaagacttcaaaagcttgaacccattgacttgccacgagtaattacttcaggaagactcctgagccagcgagaagccaggacaatgcacaaagcaaagcaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccggaaattcaaagaatacagaatttttgaaacatcaagcagtgaataactgctgtccctggaaaattggcaaaatggaaacatggcttcatgaacaagaggcccagggacagcttctctgggacagttccagctctgactcagatgagcaggggaaagatgagaagaagccacgagcactggtgaggaccaggacagagagaatcccacttttcgatgagttttttgatcaagaataagaatactattcattaacctagaaactgagtgctttgaaagcttgttttactctcaaaatcttccaaactgatatatgaattactttgaggacagcaaatcactttggtaaaaagaaatgatatctttagagtcttatgattaacaagtccgtcacatgtgctgttaactattgctgcataactaaatgcctcaaaacacaggggctaaccaagagccattttattgtctcactttcctgtgggttgctgagttcagctaggtggttcttctgctgttcccttttgaaatctttcatgtcattgaaattggactacatttggactactaagactggagtcatccagaggccccattaggacactgacacagggggaccttgccccctatccatgtagcctcagagcatctgcatatgatctcttcagcaggacactgcagagatttctctcatatgagcccagggctcccaaaagcaattgtctcaagaggaggaaacagaagttgccagtcttcttaaaagctagtcatagaactgactttgcatcacttccaccatgttctgttggttaaagtcatagaccagcttggagttaatgcagaagaggactacacaagggcatgagtgccaaagtgtggtcctttggggttcatctttgacatttgccacctcaccatgtttttaaaaagaaaattagattacataaaacaaatagatgggctggatgtggtggctcacacctgtaatcccactacttgatgcgaaggctgaggcaaaagaattgcttgaacccaggagatagaggttgcaatgagccaagatcactccactgcactccagcctgggcgacagaatgagactctgtctcaaaattaaaaaacaaaaaaccaaaaacaaatagatgaaaaagtagactggagacaaataaaagtgagtttctaaaggaaattcacagtaatgctgcattaaacactaagctcacttaggtcactttctagtgagctaaccgtaacagagagcctacaggatacacgtgagataatgtcacgtgtagaagatcgttgtgaattaaagttcaaaattaagacttcttagattatgatgtagattttagagctccttaaaacataaagcgaatcttataaatgttcaattctaaagttattccacttggaaaaattagcttttgggacaatttttaagaacttttgtgtaaatgcagctccatgtttagcataatctaaaaataatttcaagcaatccagaatcttccaagaatttattaaagctttaaaacaaagcaaaacaaaaagacccttttgtgccttatatgggaagactccaaaaacagaaaaaaatagaggaaaacaccacttcaatttgacattcaatgcattcacatcagaaactaagaagataacaagcctgagatgtcaggtgataaaaattcatgtttcttccaaggacagaaggctattagattgtcccaggccatatctattcccagttctttgtgagtagtcttcttactttttctgtggtaggtaagaagcatatttccaccaaaagaaagcatgcattgtttgactagccagctttctagaaaaaatgagatccttgagaggataaacaaatccaacctattcatggtgtcctcacttattgtggtcaatttggaaggcttaaaacacaaaaaatgggatggataactttgaacactaaaattagtggagccaaaggcacgtcttcaccattctgttatgtgacttaaaattcaatttcacgaaacccacttccacaagcttaatgaactgtgagctacatgagggcataaaccatgtcttctttgtatggtattcctgcttcctagcaggacagctggcaaagagtttatcattaaatgtttgctgaattaatgaaaaaaaa

SEQ ID NO: 8700 - DNA, 2659 bp, Homo sapiens
ctgtaatgctgttagaatcacctttcctgtatgctctcagaaataagtgccgcttttgcaaagtgttaagataatttaatgtctggcttttctgtttcatcatctcatggcatgaggaatgctgactgctctaaacgttgaacttctagaagcttgaacccattgacttgccacgagtaattacttcaggaagactcctgagccagcgagaagccaggacaatgcacaaagcaaagcaggtactagaaaagaaaatgcaaactccaatgtatacttctgagaacagacaatatttgcataagatgcaagtgctggaaatgatccgtaaaagacaagaggcccaaatggagttaaagaaaagtcttcatggagaggcaagaattaataagcaaagtccaagggaccataaagccaagaaaacccttcaaagcaccccaaggaatgatgaccatgaccttctaaccatgttgcctgatgaaatcttgaacagaggtcccggaaattcaaagaatacagaatttttgaaacatcaagcagtgaataactgctgtccctggaaaattggcaaaatggaaacatggcttcatgaacaagaggcccagggacagcttctctgggacagttccagctctgactcagatgagcaggggaaagatgagaagaagccacgagcactggtgaggaccaggacagagagaatcccacttttcgatgagttttttgatcaagaataagaatactattcattaacctagaaactgagtgctttgaaagcttgttttactctcaaaatcttccaaactgatatatgaattactttgaggacagcaaatcactttggtaaaaagaaatgatatctttagagtcttatgattaacaagtccgtcacatgtgctgttaactattgctgcataactaaatgcctcaaaacacaggggctaaccaagagccattttattgtctcactttcctgtgggttgctgagttcagctaggtggttcttctgctgttcccttttgaaatctttcatgtcattgaaattggactacatttggactactaagactggagtcatccagaggccccattaggacactgacacagggggaccttgccccctatccatgtagcctcagagcatctgcatatgatctcttcagcaggacactgcagagatttctctcatatgagcccagggctcccaaaagcaattgtctcaagaggaggaaacagaagttgccagtcttcttaaaagctagtcatagaactgactttgcatcacttccaccatgttctgttggttaaagtcatagaccagcttggagttaatgcagaagaggactacacaagggcatgagtgccaaagtgtggtcctttggggttcatctttgacatttgccacctcaccatgtttttaaaaagaaaattagattacataaaacaaatagatgggctggatgtggtggctcacacctgtaatcccactacttgatgcgaaggctgaggcaaaagaattgcttgaacccaggagatagaggttgcaatgagccaagatcactccactgcactccagcctgggcgacagaatgagactctgtctcaaaattaaaaaacaaaaaaccaaaaacaaatagatgaaaaagtagactggagacaaataaaagtgagtttctaaaggaaattcacagtaatgctgcattaaacactaagctcacttaggtcactttctagtgagctaaccgtaacagagagcctacaggatacacgtgagataatgtcacgtgtagaagatcgttgtgaattaaagttcaaaattaagacttcttagattatgatgtagattttagagctccttaaaacataaagcgaatcttataaatgttcaattctaaagttattccacttggaaaaattagcttttgggacaatttttaagaacttttgtgtaaatgcagctccatgtttagcataatctaaaaataatttcaagcaatccagaatcttccaagaatttattaaagctttaaaacaaagcaaaacaaaaagacccttttgtgccttatatgggaagactccaaaaacagaaaaaaatagaggaaaacaccacttcaatttgacattcaatgcattcacatcagaaactaagaagataacaagcctgagatgtcaggtgataaaaattcatgtttcttccaaggacagaaggctattagattgtcccaggccatatctattcccagttctttgtgagtagtcttcttactttttctgtggtaggtaagaagcatatttccaccaaaagaaagcatgcattgtttgactagccagctttctagaaaaaatgagatccttgagaggataaacaaatccaacctattcatggtgtcctcacttattgtggtcaatttggaaggcttaaaacacaaaaaatgggatggataactttgaacactaaaattagtggagccaaaggcacgtcttcaccattctgttatgtgacttaaaattcaatttcacgaaacccacttccacaagcttaatgaactgtgagctacatgagggcataaaccatgtcttctttgtatggtattcctgcttcctagcaggacagctggcaaagagtttatcattaaatgtttgctgaattaatgaaaaaaaa

SEQ ID NO: 8701 - DNA, 376 bp, Homo sapiens
cccgggggcccaggccatacaggcagggctgggccaggcctccatgatgaagtcagaccctctcggttctctctgtcttctctccatgtgggtctgcagtccctctctgtccctgttctgagactccagctttctggagcaccgctcacctgttcccgtctctttctcttgcttctctgcttacagtcatctttccttctgtagacagctgcctccatgccacaagggcctccagcatggagaactgttgccacaggtcccggtcccagacgactgaagtctgtccttcacagcagctggggcagtggagcccaggggaccccacgggcaccctggatcacacacagcctagggaccagtgcagccccagaggagc

SEQ ID NO: 8702 - DNA, 810 bp, Homo sapiens
aagtgtggaacgcagaataatttcaggaggaacaaggacgcactgtttatttcaacagacagatatttattttttttataagcattagaaaaataactggctttccagtacccggtttgtgattgaagttgccgccttaaatatatttaaggagaaaaaaagagtcagtttgaattttttaaaaaatgtaacatttggtaaatagcagtacagatggtccacggacataaaggtgcaacgcgagactgaaacgtgtgcaacgccgtcctaagagaagcccctcgcccgctggcggggagcggacagtgccccgcgccgggagcttggaaagccggccggatcggacgctggcgctgagctacgtggtaaacccgggaacagttcctctccccgttctctgggcccgaggtccgcgcctacaaaacgcgtggggtgtcacaccacaaggagacaccccgagaatgcggtcaggggccgcgagacggtggcgggggacagcgctcagtacaccgctcggcgctgcacgcctggagaacgcccggtgccacgggacgccttgggcccggttcgaatcccgactgcgccactgactcgctgaggacccgcgggcgagcgactccaccgtttcgacagggggtgcgggatgtgcggctcaaccagagaagccttgaggactcctagtgaccgaccgttcgtgcacagacaggcggctgcgatgcgacgccgccgacctgcgtccaccacagagaaccataggccgcctcggccggccgggcctgggcctgacgggagccggaggcggccgcgccc

SEQ ID NO: 8703 - DNA, 563 bp, Homo sapiens
cttgtgagaggattgactccagtttcaaaagaggttcagctgtgggtaaagtggccaacaatattgcatgccctagggaaatctttgatgaaaggaagaattaatagatgtgacaaacttttgttgtcttattttaagaaattgtcacaaacaccccaccttgagctaccaccaccctgagcagtcagcagccaaaaacgttgaggcaaggcactttattcggcaaaaagatactacaactctctgaaagcctcagatgattggttacccgttttttgggcagtaagaacatttttaagttaaagtgtgtacattgtttttgatttttattttttgagactgggtcttgctctgtcacgtaggctgcagtgcagtggtgtgatcatggctcattgcagcctcaacctccctggctgaagcaaccctcccattttagcctcccagctacttgggaggctgaggtgggaggatcacgtgagcccaagaatccaagtcaatgtgagttactgtcacactgctgcactccagcttgagtaacagagtgagaccccatctcttaacaa

SEQ ID NO: 8704 - DNA, 287 bp, Homo sapiens
aaaaaaaaaaaaaatagctggatgtggtggcacatacctgtggtcccagctacttgggaggctgaggtgggaggatcacgtgagcccaagaatccaagtcaatgtgagttactgtcacactgctgcactccagcttgagtaacagagtgagaccccatctcttaacaaaaaaaaaaagaataaatgaaaatttaagactaagaattaaatagaagtttagattcatcttactgatttataaattaatatttttgaagagtctctgatgaatctggcagagattttaa

SEQ ID NO: 8705 - DNA, 798 bp, Homo sapiens
cagtgggaagcaaaggtggggttcttgagccagacccagtccagctctggtgcctgccctctggtgcgagctgacctgagatgcacttccctcctctgtgagctgtctcggcacccacttgcagtcactgccgcctgatgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggta

SEQ ID NO: 8706 - DNA, 305 bp, Homo sapiens
aaatgctcaatttctagttctatcttgggccactaattctctgtgtgacttgaccaagttccttaaattctcaaattccctaatttcttctagttgcaacttcttcattattctagtttgtacagtagatgattctccctcattgtaaatacaaaagaggccaggcatggtggttcacacctgtagtcccagctactcaggaagctgaggtgggagcatcacttgagcccaggaggtggaggctgtggtgagctatgatcatgccacttaactctagcctgggcaacagagaaagaccctgtctc

SEQ ID NO: 8707 - DNA, 635 bp, Homo sapiens
tctgccctgaggatacataactctaagaggatgtacgactgtaaaccacacagtgtacaccttcctgcctactttttactttcctacctctgcctctggttttggtctctggcagctgctgatttgtggcaacaccccagagctcagagtcagaagactgagtttcagttccattattgcctttcttttagccatggtatcaatccctctcagtcactaagtgattgcgacaacacctcgtacagtcgttggtggcattaaatcagatcgtctatgagagtattttgtataaactgtaaagtgactgtaggagcttgtagttctcatgagtatcactgctcctcttttccacagttcacagactatcatcagtggaacagtgctggtgttggtaccggagcaaccgacaccaaaaagaagaaaataaatcatggcactaaccctgagacaaccacttcggggggctgccactcgcctgaggatgtgagtcttggctggccggtctcctgaggacaaggggcacaagggggaggtcgagggtaactgttaagattgtggaaggaagaactgccgggtactggctaagaattctgggtttgagtcctacttctctctccatctgcgagggacacggt

SEQ ID NO: 8708 - DNA, 739 bp, Homo sapiens
ggtacaaaagcaatacacattcagtaaaaccatacttcggattttgaattttgatattttcctgtatgcagtaggatactctctctcattgctgggcagcggcagggagccatagctcccagtcagccacgcaatcaagagggtaaacaatgatactccacagtacgttgtgttgccagatgattttgccctgtggtggactaacaacataagtgttctgagcaagtttaaggtaggcaagcctaagttatgatgttcagtaggttagctgaattaagtgcattttttacttaatgatattttcaagttgcaaagggcttaaggacataaccctatcataagtctaggagcatctgtacttttaaaatattgtgcttcctatttcatttagaattatagtatgagtgtgtcttctgccaagtaatatactttgaaaagaaataactgccaaggctgggcacggtggctcatgcctataatcccagcactttgggaggccgtggcaggtggatcacctgagttcaggagtttgagaccagcttggccaacatggtgaaaccccgtctctactaaaaatacaaaaattaggcaggcatggtggtgtgtgcctgtagtcccagctacttgagcagccgaggcaggacaatagcttgaatctgggagggggaggttgcagtgagccaagattgggccactgcacaccagcctgggcaacagagcgagactctgtctcaaaaaa

SEQ ID NO: 8709 - DNA, 487 bp, Homo sapiens
gttcaggcaattctcctgcctcagcctcccaagtggctgggaggctgggattataggcgtccaccaccgtgcccagctaatttttttatttttagtggagacggggtttcaccttgttggccagactggtcttgaactcctgacctcaggtgattcacctgccttggcctcccaaaatgctgggattacaggtgtgagccaccacgcctggccagaaaagaggcttcattgactcagttctgcatggctggtgaggcctcaggaaacttatcatcatggaagaaggcaaagaggaatcaaggcacatcttacattgtggcaggagagaaagagagagtgaaggggaactgtcacacacttttaaaccatcagatatcatgagaatgcactattttgtgggaactcatgagaacagcatataggggaacctgcccccatgatccaatcaccacccaccaggctctctcttgacatgtggggattacaa

SEQ ID NO: 8710 - DNA, 577 bp, Homo sapiens
atcttctcttagagaaatcaaatactttaggcatatgatagtcagagaatggctatcaaattgcaaggcatattggttgatcagttagttagttctgtttgatgagaccactgggctgttgagaccagattcctgggttccaatcttaagtaatctgagagccaacacatgggtcatattagttccccaaacttagccacatcttgtggggctatggtgtcaccccaagagcaggaggagcatggatggatggcaatccatctccaccactggaaccccaaattctgaatgcatcacctgttagagtttcttgttcataaaatagcagggaatttaggaatttagttttttttaatagtttgggccttttatccacaccctcaggagcttaggatacttttctccttcagctcactctgaaactccctctggaagctctcccatgtgtgcacttcagacacttaggggtgtcttggtgctttcttgttccaaatgctttgctaacagaccttgggagaacccccaagccaacaccacttctgggatgaaaggaaatcaataaatgctcctcacagag

SEQ ID NO: 8711 - DNA, 365 bp, Homo sapiens
tgcttgaacctggaaggtggaggttgcagttaccagagattgtgccactgcactccagcctgggcaacagagtgagattctgttataaaaataaataaataaaataaaacaaagttgggaaaatacttttttttcttcaacttttattttaagttccagggtacatgtgcaggatgtgcaggtttgttacataggttaatgtgtgccatggtggtttgctgcatagatcaacctatcacccaggtattaagcccagcatccattagttattcttcctgatgctctccctccctccatgccccacatatttattttgcagagttaaaagtgatacaattaaaagtgataggtgtactggatgttaa

SEQ ID NO: 8712 - DNA, 467 bp, Homo sapiens
acaattacttaatgccttaaataataggttttattgcattgaatttatcattatggtctcataagtaatggtatgaagatacctttattgaaggatactacaagaaacagccttatgaaacctgtgactgtatggccatatttctacagaaacaatgcttgacatctctcaatatctccattatgaaactctgtgctagaaatgtgttttagagctgcatgttagaggaaagctacaaactttattttttccttaaagaccatgaaaattgtgtaactagttatgtttttctatttcgctttggctgccaagaagctcagaaccaaatctgcagcccatctatagcaaccatatgagtccttatgaccagagcatatgtggcattatcttttttccaaatctctacataattttgacttataattcagctgattctaataattttttaatttatatttgactaaatc

SEQ ID NO: 8713 - DNA, 964 bp, Homo sapiens
  misc_feature (721)..(721): n is a, c, g, or t
  misc_feature (726)..(726): n is a, c, g, or t
  misc_feature (731)..(731): n is a, c, g, or t
cggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggggtattattgaagctcgtttgttatgtctttgtccttggcattctgttcacgggcaccaaagacttacttaaatctcaagtcattgctgcagacttcaaactcaagactgtaggtttatgggagatatatagtggattagttcttctggcagccttgctctttagaccacataatcttccggtcttagccatttagcctcttggattcagactctaatgactaaattcatcttggaagccccggagaacacgatgcagtgagattactgtgatgcattatggttggccangcatncttcnatttcacccggcaatcgccacgaaaattgcaccggggacctctcacgccggacttgtgcgctaagacacctaagtggagttccagccgtgcccgacacgcgtagggaagtacggaggccgggttgtggcccgcccctaggaattcctgagctcgaaaacccgggtacgcgcgatcagttgctctcgacgacgatcgtatccgatcgaacagctgtcgagccagggacactgag

SEQ ID NO: 8714 - DNA, 1973 bp, Homo sapiens
cggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgatatccgacatccaaagcacgatccaacagacggatgtggcatgcgacacatggacgatagcacttggattaccgagttccaaaagacagtgtagggagcactcctattcccagttgtggaaggcaagaccaactgagcagagcagaaagcgacttacaacataagcactccagatgcagccttacgtaaacctgtcgcaagagaaatgtgccgacatatgaacaaagctcctgcgcactgcgcacgtaacaccatgatcagcacagctcgcaatggaaaacatggaatcaacaccagtaaaagagacggcacaagacaatcagaagatccaataccaccctggagactccaaagaaacacagggcaggaacctagaagcaacagaaccacgcaaggagcagaggcaccagatggaagtggcacacacgtgggacaccaagataagaccaaccaaatacacactgaatggaggacagaccacgacccaaagaccgaacggacgagatcatcaacccgtgctgcccagaaccaagcatcccaccaagaccaactagagcaagaaaagggctgagaacaagaaagaaccaattgaacaaacaccgtggggggttatccacgtgggacacacactcgcgagatacatggaacaaatacggacggacgacggtcacagcatgatgcaccaaccagaagacaggaacgagagaaacaacaggagcacaaacgaagcaggaacaaaaagaagaacaagacacagacacgcgaacaatggacgacaacgcaagacgcaacacactcagcgtgcgagcgaaccgacaaggcagccacggggccaacacaaggagcgagaaccccacagctcaggaccaacgcagcagcacagccacagaccgacggagcgcacccaaggtacaagacagcacaaagaggccaaagacacggcgccacaacacagaagaccgacacacagacgcgaaagaaaagtgaacacacgcaac

SEQ ID NO: 8715 - DNA, 320 bp, Homo sapiens
ggagccggaagcgcggctgcagcagggcgaggctccaggtggggtcggttccgcatccagcctagcgtgtccacgatgcggctgggctccgggactttcgctacctgttgcgtagcgatcgaggtgctagggatcgcggtcttccttcggggattcttcccggctcccgttcgttcctctgccagagcggaacacggagcggagcccccagcgcccgaaccctcggctggtacggacccctccccggcgtctccgctcccctgaccccacatcccctagaagaccttttttctgagcctcgctgctcggatttcttctcg

SEQ ID NO: 8716 - DNA, 4703 bp, Homo sapiens
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8717 - DNA, 4661 bp, Homo sapiens
agtgtaatgctagaagtcctagaagaaatttggagtgtgcgtgcgcgccgagcggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8718 - DNA, 5578 bp, Homo sapiens
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgagggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8719 - DNA, 5825 bp, Homo sapiens
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgagtgacctgctcctacctcaccctctaatcgccctttcccctctccttcttggaaccagcactgccagtcccagagtcttgcccgatcctcctttgccctctccttcctgccttttccttcttgtcctgctcccatcaaggcgtctgtgcctccccactggtaccttcttgttttattgtgcccttggcccctgacactggcgacaccccctggttctgctcactgtggtgctgtgtcccacaggtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgagggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8720 - DNA, 5729 bp, Homo sapiens
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggtgaggtgcccaagcgctgtggggaggcatgagcagtcccaggaaattcctgctgtgaggggccggggaacccagactttcccttagtggattcttcgcagcctagggaaggggcaggaagctgtgctcactcctctcctgtctgtcccaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgagggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8721 - DNA, 5398 bp, Homo sapiens
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgagggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8722 - DNA, 5157 bp, Homo sapiens
agtgtaatgctagaagtcctagaagaaatttggagtgtgcgtgcgcgccgagcggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgagggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8723 - DNA, 5095 bp, Homo sapiens
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8724 - DNA, 4641 bp, Homo sapiens
ctcgaactcctgacctcaggtgatccgcctgccttggcctcccaaagtgctgggattaaaggcgtgagccaccgtgcccggcctacctctgcctcctcctgccccctccccagcgtctttgctgttgtctgctgtgaccttattgttggaggagtgggtggctctctgttgaaagtccctaatgctcctctctcctttgctagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgagggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8725 - DNA, 4222 bp, Homo sapiens
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgagggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8726 - DNA, 3262 bp, Homo sapiens
acgtacatggagaccaggcttggctgtggggcagagctgccaggggttggctaggctatcagacagggagggtgtggtatggatgtgttgacccctgaagtggttctgatgacctttccctatctcactctcctcagacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgagggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8727 - DNA, 6011 bp, Homo sapiens
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgagggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggtgagagaagcctgggacggggagaaaaaagaattgagctcaagttcaagggggagaaaaaaagaattgagctcaagttcaagggatcgaggccaagagctgatctccttgatgtccttggatcattaattctgaagaatgttgattccactaaatttgctgtggattatagaatattaagccgcgtgagtctttgcagaacttttcacagcctatcctatgctaatatgcattgtgactgtcctgtaacggcatctgggtagagggcacaaggcactgtccaaccttgttggaccgcaggtgcatctgtgtggactggtgcttcttgggagtacatttcgggaagcacagtgggctgggggtgggaagctgcgctggcaggttagcagtgagaaccctgtctgactctctcatgtccatttctctcaccaaggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8728 - DNA, 2368 bp, Homo sapiens
taccgcacgaggcagtgctgggggtgtgcggaagaatggagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8729 - DNA, 1262 bp, Homo sapiens
aggaatggaaggccgggataatcggacgagggcacctccagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8730 - DNA, 1646 bp, Homo sapiens
cttggagccctgttactagttcctcccaggaggagagcaggtttcctggtcttggaagccttgacctcgcatagcactagtttaggggaggagcatgaggtgggaagctgtggtagaggaaggatgccagcttcatgggtcctggtccgggtcctggatcccagcctctgccttctgaaccccttcttgggcagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggtgagagaagcctgggacggggagaaaaaagaattgagctcaagttcaagggggagaaaaaaagaattgagctcaagttcaagggatcgaggccaagagctgatctccttgatgtccttggatcattaattctgaagaatgttgattccactaaatttgctgtggattatagaatattaagccgcgtgagtctttgcagaacttttcacagcctatcctatgctaatatgcattgtgactgtcctgtaacggcatctgggtagagggcacaaggcactgtccaaccttgttggaccgcaggtgcatctgtgtggactggtgcttcttgggagtacatttcgggaagcacagtgggctgggggtgggaagctgcgctggcaggttagcagtgagaaccctgtctgactctctcatgtccatttctctcaccaaggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8731 - DNA, 719 bp, Homo sapiens
tgtctttccctgctgctccatagccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8732 - DNA, 525 bp, Homo sapiens
  misc_feature (34)..(34): n is a, c, g, or t
gtagctgactatctagaagttgcgcggccgtgcngagccgtcaccacacatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8733 - DNA, 5283 bp, Homo sapiens
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgagggtagccacctggggcctcctggagcctgccctctgcccagtctaggactggattgttggggggtgggtcttaagggaggtgtttctgctccagggacccaggctggtgttgcttccaccactaggccctgcctagggacaggcccctcgctagcttctccccactaggatggggttccgggctgcagccagaggagggcagcctggggggatggcactgggatgggcaggcagaggtgctgtctccaggtaagcgacttcaggcctagcctgggggcaggggcaggaagtatgcccacttaggagtcagttgtcactgatgaagagacatgcatagattctgggccaactctgggtggggtctgggcttcaagggcaggtggaaggcagcccctccaggtgcctgagggagatcccctgcaggcagacgcaggactcaggactgggctttccagccccactcttcactccattgcaagctaggcagaatacggcctcgatgggcaggaggaatgcctaggctggcagtgcccacaggagtttggcggaccagagccatctgtccatgtgtccatggactcaccctgcttcctccatctgccagcatgcctccatcttccgcacacccccagctcgacccctcgtgtaacctctccctggccttgttcctttctcaataaatccccttgtccctggctcctgtgattcttccctgaaggtgccccacctcctgagtcccccgttctgtgtgggttgagaagctctctctgggaccttggcctgtcctctccctggtcagcgtgtcagggcagtgtgggtagcaggggtactaaccccaggttgaggtccttgctaaccctagtctctccccacaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctccccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggtgagagaagcctgggacggggagaaaaaagaattgagctcaagttcaagggggagaaaaaaagaattgagctcaagttcaagggatcgaggccaagagctgatctccttgatgtccttggatcattaattctgaagaatgttgattccactaaatttgctgtggattatagaatattaagccgcgtgagtctttgcagaacttttcacagcctatcctatgctaatatgcattgtgactgtcctgtaacggcatctgggtagagggcacaaggcactgtccaaccttgttggaccgcaggtgcatctgtgtggactggtgcttcttgggagtacatttcgggaagcacagtgggctgggggtgggaagctgcgctggcaggttagcagtgagaaccctgtctgactctctcatgtccatttctctcaccaaggcctgtgtggactgtgggagcagcacccaagatcctggtcaccctgatgacccactcttctcagagctggatggccggatatatgcagttttttacgcagccattctacacgttccataacagggatagccggatatatt

SEQ ID NO: 8734 - DNA, 435 bp, Homo sapiens
  misc_feature (40)..(40): n is a, c, g, or t
gcggccgcctactactactactaaattcgcggccgcgtcnaccccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8735 - DNA, 388 bp, Homo sapiens
gctcggtacccctttccggcgggctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgc

SEQ ID NO: 8736 - DNA, 3027 bp, Homo sapiens
  misc_feature (3025)..(3025): n is a, c, g, or t
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgagtgacctgctcctacctcaccctctaatcgccctttcccctctccttcttggaaccagcactgccagtcccagagtcttgcccgatcctcctttgccctctccttcctgccttttccttcttgtcctgctcccatcaaggcgtctgtgcctccccactggtaccttcttgttttattgtgcccttggcccctgacactggcgacaccccctggttctgctcactgtggtgctgtgtcccacaggtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggtctagccccaggcccagcccccagcccagcccccagccccacagtagcccctgacccagccccagacgcctaccgtccagtggggctgaccaaggccgtgctgtccctgcacacgcagaaggaagagcaagccttcctcagccgcttccgagacctgggcaggctgcgtggactcgacagctcttccacagctccctcagcccttggcgagcgagtgctgcacgacggcccgcaccccaagcggcgaacactgcgatccaaagcaagcgtcacgcacaacagaacctcgggtgaagngc

SEQ ID NO: 8737 - DNA, 1017 bp, Homo sapiens
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgcttgaacccagggggtggtggttgcagtgagctgagatcgcaccactgcactccagcttgggagaaagagtgagactccatgtcaaaa

SEQ ID NO: 8738 - DNA, 458 bp, Homo sapiens
tcatacttgtactgaccacagtcggggcgattgcgtagagtcgactgtgtaggcatgcgtgctatgggagcgctcgtcgcctgacaaccgtcgtagaccccctggttctgctcactgtggtgctgtgtcccacaggtgactttccagcagatctgtaaggatgtgcatctggtgaagcaccagggccagcagctttttattgagtctcgggcccggcctcagtcccggccccgcctccctggtgagttgatgatgatgtgtgggtgaagagacagacctggggggtcccctgacctggactcaataattgatagattttcctagagtaacagtatgagagctccagccattccattaaaagtattagttctgctttgagctgaaaccagttgagcctaatggaagactggatgtctttcttcttcaaccgcatcacccgttcggggatgctctattgt

SEQ ID NO: 8739 - DNA, 394 bp, Homo sapiens
ccctggcctggtgggggctgggaggaaggacatttcctcatggccagacatgaatttgggaggcatgaaccacaccctttgaattttggaacaagaaaagctattgtaaagatgaggatttgagctcctcttagaggtagagttgaataaggtgcccaagctagaggagggcagagaagaatgccttgcttgctctcagtcatgttactgatacagggcataggattggcccagaccatctttgggcccatagtgcccggggcagagctgtgtggcagatcatcagccagcctgggcccaggcagagtggagggctgaggagttgggcattctggacgaaacccagtgaccacactctctgtgcctcagctccccggataccccctgacaagag

SEQ ID NO: 8740 - DNA, 463 bp, Homo sapiens
tcaagttcaagggggagaaaaaagaattgagctcaagttcaagggggagaaaaaaagaattgagctcaagttcaagggatcgaggccaagagctgatctccttgatgtccttggatcattaattctgaagaatgttgattccactaaatttgctgtggattatagaatattaagccgcgtgagtctttgcagaacttttcacagcctatcctatgctaatatgcattgtgactgtcctgtaacggcatctgggtagagggcacaaggcactgtccaaccttgttggaccgcaggtgcatctgtgtggactggtgcttcttgggagtacatttcgggaagcacagtgggctgggggtgggaagctgcgctggcagtagcagtcagaaccctgttcgacatctcatcatcttcatatataatcgacagcccaggcctcatagtcgtgagcagtgcggagcagcac

SEQ ID NO: 8741 - DNA, 368 bp, Homo sapiens
gaggtgctgaccacacagggtctgaaggcaaggaaaattgaacatccctgaagggtctttggatattgaccttgaaaatcatgaggggctgggcatggtggctcaggcctgtaatcccagcattttgggaggctgaggtaggaggatcacctgagatcaggagctcgagatcagcctgggcaacatggtgaaaccctgtatctactaaaaatgcaaaaattagccgggcgtggtggcgcgcgcctgtagtcccagctactcgggaggctgggacaggagaatcgcttgaacccagggggtggtggttgcagtgagctgagatcgcaccactgcactccagcttgggagaaagagtgagactccatgtc

SEQ ID NO: 8742 - DNA, 351 bp, Homo sapiens
ctgctgggctacctgccccaggacctcctgggggccccagtgctcctgttcctgcatcctgaggaccgacccctcatgctggctatccacaagaagagtgagttcctctcgccctgctcgcccttcccactgtcctgggcttttgagtggctgcccttgtggttgtgtctcttggtgccttggtctcctggatctctagtggcatggcctccctcttactcagctctccctccctttgaccgctcctcctttcccacttccatcagttctgcagttggcgggccagccctttgaccactcccctatccgcttctgtgcccgcaacggggagtatgtcaccatggacaccag

SEQ ID NO: 8743 - DNA, 2434 bp, Homo sapiens
atgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgagtgacctgctcctacctcaccctctaatcgccctttcccctctccttcttggaaccagcactgccagtcccagagtcttgcccgatcctcctttgccctctccttcctgccttttccttcttgtcctgctcccatcaaggcgtctgtgcctccccactggtaccttcttgttttattgtgcccttggcccctgacactggcgacaccccctggttctgctcactgtggtgctgtgtcccacaggtgactttccagcagatctgtaaggatgtgcatctggtgaagcaccagggccagcagctttttattgagtctcgggcccggcctcagtcccggccccgcctccctggtgagttgatgatgatgtgtgggtgaagagacagacctggggggtcccctgacctggactcaataattgatagattttcctagagtaacagtatgagagctccagccattccattaaaagtattagttctgctttgagctgaaaccagttgagcctaatggaagactggatgtctttcttcttcaaccgcatcacccgttcggggatgctctattgt

SEQ ID NO: 8744 - DNA, 1433 bp, Homo sapiens
actcagggttggttaaattgggaaggaacttggaaatggttctcttgggttcttccccttacaggcccacttgttagtctcctacttttgctcctttttggtccatgtctcctaaatctaataacccaatttgtctcctctcgccttcaggccataaagctccagacgaatctcagtgcaggacgccatcctcgcaatattcaagagtcacccttctaaggaggacccctagacgtgctcgctagtggaacacgacagaggcgaaatcctgccccgtctcccgtggacctggctggatatggttttggccaatccacagagccatcctgccctgacagctagcaagaggccaagacccacagaacaaccactacagcccctctgtcagcaggaagcagttaaagaagactgaccttcgtccattttcccagataattgggtcttggactcttgagggggggaaatgttggagcaggtagctagtcagacatgagcagggcaggggagggccccctcaccaggaatgtcaggcaaccatcaggtgatggtgaggcagttgttaagctgtgtctctaacataataatgagtggcagctggcgccagggaacgatggcctcccaatagataggaaacacctgaagctggtgatcagccacttcctgataagatctcaggagttgggtgcgcaggctcaagcatgcaccctaagaggcaaaatagtggcatttaactcatatatgaccttcctttaggaaggcttgactggtaagggaaaaactcctccagtgaacacgtgcacaacttcagtaaaaacactgcacatgcgtcccctcccaagtgctggcaggccactgtgcatgcagacagcccgccccaaagaaaaatcagaggaggagaaatggaaaccccggaacaatgccaatgtataaaaccccaagtcaagggcctaccaaggcaattggatctctcaagtcacccgcttggctctcttcaagtgcactttgcttccttttgttcttgctctaaaacttttactcctgctataaaacttgccttggactatcatgctaccttacgcctccccggccaaattccctcctctcctccggggggcaaggatggagtctgctgcagacccattggatttgctgctggtaacagttccaccatttaggttccagcaccaagcaaactaacacccgactcagtgtaaacagccaaacaagcttaaccaattagaaaccaccatctaacctctaactaggtcctttcaactttaaccaagtattttctttgtcttgcttctgtgggaaccttataaaattttcccccttgtacctctgtagtagagacccagttgcttgcagtttggccctgcctgttcatgaatcacccttgctcaaataaactctctaaaatgctaaaaaaaaaa

SEQ ID NO: 8745 - DNA, 430 bp, Homo sapiens
ttgaagagagccaagcgggtgacttgagagatccaattgccttggtaggcccttgacttggggttttatacattggcattgttccggggtttccatttctcctccggggggcaaggatggagtctgctgcagacccattggatttgctgctggtaacagttccaccatttaggttccagcaccaagcaaactaacacccgactcagtgtaaacagccaaacaagcttaaccaattagaaaccaccatctaacctctaactaggtcctttcaactttaaccaagtattttctttgtcttgcttctgtgggaaccttataaaattttcccccttgtacctctgtagtagagacccagttgcttgcagtttggccctgcctgttcatgaatcacccttgctcaaataaactctctaaaatgctaaaaaaaaaa

SEQ ID NO: 8746 - DNA, 618 bp, Homo sapiens
ccatgaggtgtgaccacgaggcatggactgtgagatgggactgtgagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtaaagttacattgtctgcacctttgtacttctttattgagtgtactggctggcaagagttctctcttctgttggtaattatttaggatttttggaatgtattcaggacctgtagcttggttttctaaagcacctcgtaaaatgatatgattactccaagccctctgcatgttttcagacagaacacattgacatattttgagacaaactgactattaatcttgtatccagtatcctgagatgaagtaaatgcagtgttctactgcctgatgtgaaagagagctatgtatgataattaaagaaaataattttctgtgtaacaagcaatctttatttaataaacaaatacattgttctgaaaagttaa

SEQ ID NO: 8747 - DNA, 568 bp, Homo sapiens
ccatgaggtgtgaccacgaggcatggactgtgagatgggactgtgagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtaaagttacattgtctgcacctttgtacttctttattgagtgtactggctggcaagagttctctcttctgttggtaattatttaggatttttggaatgtattcaggacctgtagcttggttttctaaagcacctcgtaaaatgatatgattactccaagccctctgcatgttttcagacagaacacattgacatattttgagacaaactgactattaatcttgtatccagtatcctgagatgaagtaaatgcagtgttctactgcctgatgtgaaagagagctatgtatgataattaaagaaaataattttctgtg

SEQ ID NO: 8748 - DNA, 2386 bp, Homo sapiens
cgccaggctctcggttctgccgacgcaggtcccgcccctctcgtagcctcgccccgcccgccggaggcgccgtccgagggctccgtttgaaacatggcgcgggctggccctcggctggtgctgagcgaggaggcggttcgggcgaagagcggcttagggcctcaccgcgacctggctgagcttcagtcattgtctattcctggaacttaccaagagaagatcacccacctgggacattctctgatgagtttaacaggtctgaaatctttggatctctcgcgcaactccttggttagtctggagggcattcagtacctgactgcattggagagtctcaatctctactacaactgcatctcctcgttggcagaagtgtttcggctccacgccttaaccgagctcgtggatgtggacttccggctgaaccccgtggtgaaggttgagcctgactaccgcctttttgttgtgcacctgctccccaagctccagcagctggacgatcgccccgtgagagcaagcgagcggaaggcttcccgactgcattttgcatcagaggactcactcgactccaaagagagcgtcccagcttctttgaaagagggcagaccacaccaccccagagccaagtgcaccgaggccttggccaagcagagcctggtcatggatgcggatgacgaggcagtcctgaacctcattgcagagtgcgagtgggacctcggcaggcctcccgggagcacgagcttcagccagaaggggcgtgaggccgactctcgtggttcccaagaatccagacatctgttgagcccgcagttggtacagtaccagtgtggggactctgggaagcagggccgtgagacgaggaggagcagctgcagagggtgctgtctggagaagatgccttggagccagctctgtggagagcttccgccactgtacggagcggagccagaggcctcccgtgcccccaggccacacacgtacttcaccccacacccagactccatggataccgaggactcggcctcttctcagaagttggatttgtcaggagaaatggtgcctggtcccctgccagcccccggaaagtgcaggaagcgaagaatgcctgttggaagattccagacgttttcggaccaggagggtttgggctgcccggagagaactcatgggtcctccgtgcccaaggagagcctgagcagacaggacagctcagaaagcaggaacgggaggaccttgtctcagcctgaggcctcggagactgaggagcagaggtctcggggtgtgaccgacaccagagagccgtctcccgggtcacactcggctctacccgggaagaagacggccctgcaggtccctgcacagcaacgaggcattccttgctcaggcaagacacatcttgtcatctgttgaagaattcacagcagctcaggacagctctgcgatggtgggtgaagatgtcggctccctggctctggagagtaagtccctgcaaagccgccttgctgagcagcagcagcagcacgcccgggagatgagcgaggtgacggcggagctgcaccacacacacaaggagctggatgatttgagacaacatttagataaatctttggaagagaacagtaggttaaaatcgcttttgttgagtatgaaaaaggaagtgaagagtgcagacactgcagccacgttaaatttgcagatcgctggacttcaaacaagtgtgaagaggctgtgtggcgagattgtggaactgaagcagcacctggagcactacgacaagatccaggagctcacgcagatgctgcaggagagccacagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtaaagttacattgtctgcacctttgtacttctttattgagtgtactggctggcaagagttctctcttctgttggtaattatttaggatttttggaatgtattcaggacctgtagcttggttttctaaagcacctcgtaaaatgatatgattactccaagccctctgcatgttttcagacagaacacattgacatattttgagacaaactgactattaatcttgtatccagtatcctgagatgaagtaaatgcagtgttctactgcctgatgtgaaagagagctatgtatgataattaaagaaaataattttctgtgtaacaagcaatctttatttaataaacaaatacattgttctgaaaagttaa

SEQ ID NO: 8749 - DNA, 2369 bp, Homo sapiens
cgccaggctctcggttctgccgacgcaggtcccgcccctctcgtagcctcgccccgcccgccggaggcgccgtccgagggctccgtttgaaacatggcgcgggctggccctcggctggtgctgagcgaggaggcggttcgggcgaagagcggcttagggcctcaccgcgacctggctgagcttcagtcattgtctattcctggaacttaccaagagaagatcacccacctgggacattctctgatgagtttaacaggtctgaaatctttggatctctcgcgcaactccttggttagtctggagggcattcagtacctgactgcattggagagtctcaatctctactacaactgcatctcctcgttggcagaagtgtttcggctccacgccttaaccgagctcgtggatgtggacttccggctgaaccccgtggtgaaggttgagcctgactaccgcctttttgttgtgcacctgctccccaagctccagcagctggacgatcgccccgtgagagcaagcgagcggaaggcttcccgactgcattttgcatcagaggactcactcgactccaaagagagcgtcccagcttctttgaaagagggcagaccacaccaccccagagccaagtgcaccgaggccttggccaagcagagcctggtcatggatgcggatgacgaggcagtcctgaacctcattgcagagtgcgagtgggacctcggcaggcctcccgggagcacgagcttcagccagaaggggcgtgaggccgactctcgtggttcccaagaatccagacatctgttgagcccgcagttggtacagtaccagtgtggggactctgggaagcagggccgtgagacgaggaggagcagctgcagagggtgctgtctggagaagatgccttggagccagctctgtggagagcttccgccactgtacggagcggagccagaggcctcccgtgcccccaggccacacacgtacttcaccccacacccagactccatggataccgaggactcggcctcttctcagaagttggatttgtcaggagaaatggtgcctggtcccctgccagcccccggaaagtgcaggaagcgaagaatgcctgttggaagattccagacgttttcggaccaggagggtttgggctgcccggagagaactcatgggtcctccgtgcccaaggagagcctgagcagacaggacagctcagaaagcaggaacgggaggaccttgtctcagcctgaggcctcggagactgaggagcagaggtctcggggtgtgaccgacaccagagagccgtctcccgggtcacactcggctctacccgggaagaagacggccctgcaggcggcgctcctggagacgctcttggacctggtggacaggagctggggcggctgcaggtccctgcacagcaacgaggcattccttgctcaggcaagacacatcttgtcatctgttgaagaattcacagcagctcaggacagctctgcgatggtgggtgaagatgtcggctccctggctctggagagtaagtccctgcaaagccgccttgctgagcagcagcagcagcacgcccgggagatgagcgaggtgacggcggagctgcaccacacacacaaggagctggatgatttgagacaacatttagataaatctttggaagagaacagtaggttaaaatcgcttttgttgagtatgaaaaaggaagtgaagagtgcagacactgcagccacgttaaatttgcagatcgctggacttcaaacaagtgtgaagaggctgtgtggcgagattgtggaactgaagcagcacctggagcactacgacaagatccaggagctcacgcagatgctgcaggagagccacagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtttactagaaattcccaactgttccaaagtggtggtacccgcaggcccgactgctagttgtgtatgaccacgtctgccggtccatgttttcagcacccattgcctgaagtgttagcaccttcactccgcttcttctatcaataattcgcctcaagaatggatgacttttatcactttttctgcagtgatggagatgaccatgatttttatcatttaatatattgatgtgtttaacgaccataatttgcttttgttaaaaataaaccttgaatttctgagataagtccaactta

SEQ ID NO: 8750 - DNA, 435 bp, Homo sapiens
gcactattatgatgtcaaaattattatatttgactgggaattagaactatttcagtccccgtatattttctagaattagaacattgttttgctagccatgaagtttatcatcttctcataaaaccatgcgtagctggaatagccaaggcgccattcagtcactcattagcctgttcagctcattcattcattccataggtgttgagccgcacctccaaggctgctcccaggggtcaggacagtggttgggaaggaggaggcaggtgggcggtagccagtgggacacagaaggtgatggggccacagagataggtctgtgtgcagggccagggcaccttcgtgcccatgcagggaggtgggcaggcccagcaggtgagggccacaccgctggagaggacggaagtgccaagcagccgcttccctgttgttctgcag

SEQ ID NO: 8751 - DNA, 782 bp, Homo sapiens
gagaaagggtgtgcgtgtgtgtgtgtgagcctcatctgtgtgcggctgctcccgtgcgcagcagtgagctctgagggacaggcggcctcagcaccacgctgggcatcgccgggaagctgtgggaccaccagagcccagcattccggtgctaggttagtgggagcagggctggccccgaggggatggacaccctgccccgtgtagatgccccagggtggatgcagccgcccgccgcttgccacctgcacagtcttgtgtggccttttcttctagacgatcgccccgtgagagcaagcgagcggaaggcttcccgactgcattttgcatcagaggactcactcgactccaaagagagcgtcccagcttctttgaaagagggcaggtatgaacggaagtgctacggacacccagagtgtttctgactggcctgctgtcaggaggattaaccgaacgtcattcactgtgtgccggtcactctccaggggcggacaccaggagggaggaagggcagagcctgcctggcggggactccgtggacagtgggacggggcctctctcctgttctccacattcctaggagttatttttaatatcgaaactgttgattaaggtaatatgtgtaaaatcaactcagcaaagggcttgtcctgtccctttcccggggctggcagctctcacgtctgtggctgcctctgcttccagctctcgcttcagctactttcttagctgcccatccagccaaatcccacttctggccgtgagcacattcagcaggacccgtc

SEQ ID NO: 8752 - DNA, 2442 bp, Homo sapiens
cgccaggctctcggttctgccgacgcaggtcccgcccctctcgtagcctcgccccgcccgccggaggcgccgtccgagggctccgtttgaaacatggcgcgggctggccctcggctggtgctgagcgaggaggcggttcgggcgaagagcggcttagggcctcaccgcgacctggctgagcttcagtcattgtctattcctggaacttaccaagagaagatcacccacctgggacattctctgatgagtttaacaggtctgaaatctttggatctctcgcgcaactccttggttagtctggagggcattcagtacctgactgcattggagagtctcaatctctactacaactgcatctcctcgttggcagaagtgtttcggctccacgccttaaccgagctcgtggatgtggacttccggctgaaccccgtggtgaaggttgagcctgactaccgcctttttgttgtgcacctgctccccaagctccagcagctggacgatcgccccgtgagagcaagcgagcggaaggcttcccgactgcattttgcatcagaggactcactcgactccaaagagagcgtcccagcttctttgaaagagggcagaccacaccaccccagagccaagtgcaccgaggccttggccaagcagagcctggtcatggatgcggatgacgaggcagtcctgaacctcattgcagagtgcgagtgggacctcggcaggcctcccgggagcacgagcttcagccagaaggggcgtgaggccgactctcgtggttcccaagaatccagacatctgttgagcccgcagttggtacagtaccagtgtggggactctgggaagcagggccgtgagacgaggaggagcagctgcagagggtgctgtctggagaagatgccttggagccagctctgtggagagcttccgccactgtacggagcggagccagaggcctcccgtgcccccaggccacacacgtacttcaccccacacccagactccatggataccgaggactcggcctcttctcagaagttggatttgtcaggagaaatggtgcctggtcccctgccagcccccggaaagtgcaggaagcgaagaatgcctgttggaagattccagacgttttcggaccaggagggtttgggctgcccggagagaactcatgggtcctccgtgcccaaggagagcctgagcagacaggacagctcagaaagcaggaacgggaggaccttgtctcagcctgaggcctcggagactgaggagcagaggtctcggggtgtgaccgacaccagagagccgtctcccgggtcacactcggctctacccgggaagaagacggccctgcaggcggcgctcctggagacgctcttggacctggtggacaggagctggggcggctgcaggtccctgcacagcaacgaggcattccttgctcaggcaagacacatcttgtcatctgttgaagaattcacagcagctcaggacagctctgcgatggtgggtgaagatgtcggctccctggctctggagagtaagtccctgcaaagccgccttgctgagcagcagcagcagcacgcccgggagatgagcgaggtgacggcggagctgcaccacacacacaaggagctggatgatttgagacaacatttagataaatctttggaagagaacagtaggttaaaatcgcttttgttgagtatgaaaaaggaagtgaagagtgcagacactgcagccacgttaaatttgcagatcgctggacttcaaacaagtgtgaagaggctgtgtggcgagattgtggaactgaagcagcacctggagcactacgacaagatccaggagctcacgcagatgctgcaggagagccacagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtaaagttacattgtctgcacctttgtacttctttattgagtgtactggctggcaagagttctctcttctgttggtaattatttaggatttttggaatgtattcaggacctgtagcttggttttctaaagcacctcgtaaaatgatatgattactccaagccctctgcatgttttcagacagaacacattgacatattttgagacaaactgactattaatcttgtatccagtatcctgagatgaagtaaatgcagtgttctactgcctgatgtgaaagagagctatgtatgataattaaagaaaataattttctgtgtaacaagcaatctttatttaataaacaaatacattgttctgaaaagttaa

SEQ ID NO: 8753 - DNA, 2392 bp, Homo sapiens
cgccaggctctcggttctgccgacgcaggtcccgcccctctcgtagcctcgccccgcccgccggaggcgccgtccgagggctccgtttgaaacatggcgcgggctggccctcggctggtgctgagcgaggaggcggttcgggcgaagagcggcttagggcctcaccgcgacctggctgagcttcagtcattgtctattcctggaacttaccaagagaagatcacccacctgggacattctctgatgagtttaacaggtctgaaatctttggatctctcgcgcaactccttggttagtctggagggcattcagtacctgactgcattggagagtctcaatctctactacaactgcatctcctcgttggcagaagtgtttcggctccacgccttaaccgagctcgtggatgtggacttccggctgaaccccgtggtgaaggttgagcctgactaccgcctttttgttgtgcacctgctccccaagctccagcagctggacgatcgccccgtgagagcaagcgagcggaaggcttcccgactgcattttgcatcagaggactcactcgactccaaagagagcgtcccagcttctttgaaagagggcagaccacaccaccccagagccaagtgcaccgaggccttggccaagcagagcctggtcatggatgcggatgacgaggcagtcctgaacctcattgcagagtgcgagtgggacctcggcaggcctcccgggagcacgagcttcagccagaaggggcgtgaggccgactctcgtggttcccaagaatccagacatctgttgagcccgcagttggtacagtaccagtgtggggactctgggaagcagggccgtgagacgaggaggagcagctgcagagggtgctgtctggagaagatgccttggagccagctctgtggagagcttccgccactgtacggagcggagccagaggcctcccgtgcccccaggccacacacgtacttcaccccacacccagactccatggataccgaggactcggcctcttctcagaagttggatttgtcaggagaaatggtgcctggtcccctgccagcccccggaaagtgcaggaagcgaagaatgcctgttggaagattccagacgttttcggaccaggagggtttgggctgcccggagagaactcatgggtcctccgtgcccaaggagagcctgagcagacaggacagctcagaaagcaggaacgggaggaccttgtctcagcctgaggcctcggagactgaggagcagaggtctcggggtgtgaccgacaccagagagccgtctcccgggtcacactcggctctacccgggaagaagacggccctgcaggcggcgctcctggagacgctcttggacctggtggacaggagctggggcggctgcaggtccctgcacagcaacgaggcattccttgctcaggcaagacacatcttgtcatctgttgaagaattcacagcagctcaggacagctctgcgatggtgggtgaagatgtcggctccctggctctggagagtaagtccctgcaaagccgccttgctgagcagcagcagcagcacgcccgggagatgagcgaggtgacggcggagctgcaccacacacacaaggagctggatgatttgagacaacatttagataaatctttggaagagaacagtaggttaaaatcgcttttgttgagtatgaaaaaggaagtgaagagtgcagacactgcagccacgttaaatttgcagatcgctggacttcaaacaagtgtgaagaggctgtgtggcgagattgtggaactgaagcagcacctggagcactacgacaagatccaggagctcacgcagatgctgcaggagagccacagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtaaagttacattgtctgcacctttgtacttctttattgagtgtactggctggcaagagttctctcttctgttggtaattatttaggatttttggaatgtattcaggacctgtagcttggttttctaaagcacctcgtaaaatgatatgattactccaagccctctgcatgttttcagacagaacacattgacatattttgagacaaactgactattaatcttgtatccagtatcctgagatgaagtaaatgcagtgttctactgcctgatgtgaaagagagctatgtatgataattaaagaaaataattttctgtg

SEQ ID NO: 8754 - DNA, 1495 bp, Homo sapiens
  misc_feature (22)..(22): n is a, c, g, or t
  misc_feature (26)..(27): n is a, c, g, or t
agcttcgcttaagatgctcccncgcnnacacgtactcaccccacacccagactccatggataccgaggactcggcctcttctcagaagttggatttgtcaggagaaatggtgcctggtcccctgccagcccccggaaagtgcaggaagcgaagaatgcctgttggaagattccagacgttttcggaccaggagggtttgggctgcccggagagaactcatgggtcctccgtgcccaaggagagcctgagcagacaggacagctcagaaagcaggaacgggaggaccttgtctcagcctgaggcctcggagactgaggagcagaggtctcggggtgtgaccgacaccagagagccgtctcccgggtcacactcggctctacccgggaagaagacggccctgcaggcggcgctcctggagacgctcttggacctggtggacaggagctggggcggctgcaggtccctgcacagcaacgaggcattccttgctcaggcaagacacatcttgtcatctgttgaagaattcacagcagctcaggacagctctgcgatggtgggtgaagatgtcggctccctggctctggagagtaagtccctgcaaagccgccttgctgagcagcagcagcagcacgcccgggagatgagcgaggtgacggcggagctgcaccacacacacaaggagctggatgatttgagacaacatttagataaatctttggaagagaacagtaggttaaaatcgcttttgttgagtatgaaaaaggaagtgaagagtgcagacactgcagccacgttaaatttgcagatcgctggacttcaaacaagtgtgaagaggctgtgtggcgagattgtggaactgaagcagcacctggagcactacgacaagatccaggagctcacgcagatgctgcaggagagccacagctccctggtcagcaccaatgaacacctgctgcaggagctgagccaggtgcgggcgcagcacagagccgaggtggagcagatgcactggagctaccaggagctcaagaagaccatggccctgtttccacacagcagcgccagccatggaggctgccaggcctgctgactcctgccgagaagctgggccaccccttaagcttcctggtaaagttacattgtctgcacctttgtacttctttattgagtgtactggctggcaagagttctctcttctgttggtaattatttaggatttttggaatgtattcaggacctgtagcttggttttctaaagcacctcgtaaaatgatatgattactccaagccctctgcatgttttcagacagaacacattgacatattttgagacaaactgactattaatcttgtatccagtatcctgagatgaagtaaatgcagtgttctactgcctgatgtgaaagagagctatgtatgataattaaagaaaataattttctgtgtaacaagcaatctttatttaataaacaaatacattgttctgaaaagttaa

SEQ ID NO: 8755 - DNA, 594 bp, Homo sapiens
agtgatctgcccacctcggcctcccaaagtgctgggattacaggcctgagccaccatgcctggccagatgtttcttaaggacagcttgcccatgtccaatccacaggggcctatagtcctacacactagtctggactattcctaaaatccaccagtcactttgcggcctgcagatcttgcccgtggactccctctccccgacatttcttttccttttctcccccagtacagtcctggtcctgatcattgtttataggcttttatttttatttttgagacggggtcttactctgttgcccaggctgtagtgcagtggcgcgatcacaactcactgtacctcctgggctcaagcaatcctcccacctcagcctcccaagtagttaggactacaggcaaacatcgtcgtgcctggctaatttttaaattttttgtgtagctggtgatcttactaggttgctcaggctgatcttgaactcctgatctgaagtcattctcttgcctcggcctcccgaagtgctgggattataagcatgagccactgtgcctggcctatgtatggtctttttaaagccagcttctcaagaaccttctata

SEQ ID NO: 8756 - DNA, 798 bp, Homo sapiens
cagtgaatgtaagaaagtttcacatcagttcatcagttggaggatttttaaaaagtggggaggttaggagaaagacattttctaaattgttacctagaatgctggaaatgaatgtggtcttaaaaaaccatctaacttaaatcacacaacacacgggaatctcaaacgggtgcttctctccacatttcattgagaaatatttctacttggaaatgctgtactgtatgaagagaagaaatccaactccatttgatacacgatttgagtacaatagggcagtgcatggccaggtctacccattcttttggcctactggtgacccccatcttaagctggatggactactgcagggaggtggtacagcagcctcactccctacaagagactattcagagaagatccaattgaattgaaagataccaagagccaccctgatgcaggtgtctcaccctgtaaggtctaaatgaaaatcagatttttctaaaattaacaggtaagcagtttttttcctaaataaaagcaaaaagactatttaatgtactttaatatgaaaaccacaaaatgaaaaaatgccgaatttcccttaaatatttacgattagaatatcaggacacagtactaccatgccttgaaacctcaggaatgacaaaggacacttaactaagttaccaggaagtaatgggggtaggaggtgtgaacggaggggagactggaggtgagtgttaaaagagcaattatgataaatgtatcctttaaacattaactaaaaaacatttatttctttgttctttcactttc

SEQ ID NO: 8757 - DNA, 156 bp, Homo sapiens
tttttttctattaatgtaacttcaatatttttaattcattcttcagtttttcttctattttttatttggggcttagtatataactttcaaatttacatgtttatataaatgcaattaatttaatattctttaaaaatctttcttctagtgtttcag

SEQ ID NO: 8758 - DNA, 402 bp, Homo sapiens
caaattaacaatcatattattgattccatagcaacgtgttaaatttgctatatccagtagcctttacattagtatagaagtaatgaacctgcattttgtattaagtaaattatattatttttaataaatcagtaaaacagcaggacaccagaatctttttgagagattttctacttcctggtcctactgctttaacttcactgtttgtgacaactttgtgtagagagatattattgaagataaaactgatggccctggctctgtaggtgatcttcccaatgaaacactcatggagatagtgttttacataaatttttaaaagcagtgatgacttctgtgtaggagtcagtttttttaaacttagattataaatgactgtgtatacagtgaatgttgctgaaa

SEQ ID NO: 8759 - DNA, 1714 bp, Homo sapiens
agtgagctgtcattgtgctgctgccctccagtctggccaacagagcaagactctgtaaaagacttctctgcattcatcttcccttttccccttccagtgggaggtgaggccaaatccctgactaaccgtccagattcttaatacctagccaagacatcagtcctcactttattttaggctgtggaaatgaaggcctctttatggaaaagtaattttaagacagatggaaacttcagaatcccaaagacttgagagttctggtgaaacagttcaaggaaatcccagctgagagacagcccagctctcagactttgcaggctttctgccatgttacttaacttgacagcagcccttatgattacctaaatgaccaacccaacttgcttttgtccatgccttaaataacataattaacagagttagaagatcaggaaagaggcctttttgtgtgtgtttcagagttcattataacccagtggaagtggaggtgagcctacctagaggttcacatttcagcctctctccgaagacaaggcagcaatgagaatggaacactgtgcccattcgctctgcttcaatgaaggatgctctttttacattttagtggacagcacaattaagcaaccgcagttggggcccagggattcagcacctccagtgagtcaggtagcctgacaggaaatagctgtaacagtctgtgcccactgtcaccttcctatccttgataaggaagctgtcctggtgcactgcttctcctgcctcctgagtgttggtacagtgggtggcctatccagatcctcagtcacccagtgctggcttcttagggaatgtgtcattgctgctgttgcagcagggcatacatctgatggtaaccgttctccgtttggagaagggttttggttctgtaagtggagggaagcgaaacctgtaaacacttgtgatgaagcggtccagggaagaacactctcaaggctgccagtgggattgttagtttcagcatgaaactaactttgactttgacataggcaaagttggggaacccagttttaaattttgagggcagtaaagtggttaggctgatgttgtcacactgtccggggccacatttgtggtaactgagtgacttaggacaagtcactttgtatctcttctgtcccaatttcatcctcggtaaaaatggcgatgctaattgtctgccccaagggtgggtgtgaggattacatgaggtaatgcattgtaaagcatctagcaccaagtgttaactgctattaaataataggtattaggatgtatgcagcttgacagctgtgtagtaattaaccacactggctgttttgtgagggcatcatctatgctacagaaaggaataatcattagactaaatattcctagaaatcccaaacgacaggctcttcaaactcaagtggaaatgagacctcatcagagtattctcctgatccagtagagtgtggtgtgtggagtcaaagcctaggtttttgtccatccactcctagttggatgttacctaacttctttgagtatggttttttcgctggtgatatgaaatcagtatgtattttgctgcgttattgtggagcttgaataaaatagtaatgcatataaagcagtggtgtagtgcctggcccatcacagcaactcaagaaaagagagctgccactatcgccgtcatcaaagcacccacttcttccctcca

SEQ ID NO: 8760 - DNA, 425 bp, Homo sapiens
tgcattcaagcatctagcactatattaggatgtcatgcagcttgacagctgtgtagtctgtaatgctacagaaaggaataatcattagactaaatattcctagaaatcccaaacgacaggctcttcaaactcaagtggaaatgagacctcatcagagtattctcctgatccagtagagtgtggtgtgtggagtcaaagcctaggtttttgtccatccactcctagttggatgttacctaacttctttgagtatggttttttcgctggtgatatgaaatcagtatgtattttgctgcgttattgtggagcttgaataaaatagtaatgcatataaagcagtggtgtagtgcctggcccatcacagcaactcaagaaaagagagctgccactatcgccgtcatcaaagcacccacttcttccctcca

SEQ ID NO: 8761 - DNA, 449 bp, Homo sapiens
agcaaagacatggagtcaatccaggtgcatccaaggcagattgaaaatccaaggtagattggaatgttccatacataccatggaatactatgcagccaagaaaagaacaaaatcatgtcctttgcagcaacatggatacagctggaatccactatcctaagcaaactaacacagaaacagaaaccaaatatctcatgttttcacttatgtgggagctacacattgggtgcacattgtcataaacctgggaacaatagacactgggaaataagaacagggagggacagagtgggccagggttggaaaactacttattgggtcctatgcttactacctgtgtgatgggttccactgtactctaaaccttggcatccctcaatattctcttggaagaagcctacacaggtaccaccttaatttagaatacaaactagaaaaaaacaaacaaa

SEQ ID NO: 8762 - DNA, 284 bp, Homo sapiens
cacgtcctctcaccaaggctctttatagcacaaacattcttactttgaatgaaatcgaattgattgatttcttctctctggccgatgctttggttgtcatatctgaaaactcttcaccaagcaccaggtacagaagattttctcttctccttttttaccacttacgagtttcatactttacatttaaatgtacaatccattttgagttaatttttgtgtaagttgtgagatttacgttgagatacgcttttttttgggacagaatcttgctctgtcacccaggc

SEQ ID NO: 8763 - DNA, 215 bp, Homo sapiens
ggtgaaattcagaggtggggatgtgggactttgactttttactttatacacttttgtgtgatttttttaaattatggatttattttattattgataaaatatacaaaggttacaatactcctgattgtaaaaaaaaatgcttagtaaagtatatttagaaaacagggaaattggaacagtttttagccaaagaaaatcccacactacatattggc

SEQ ID NO: 8764 - DNA, 928 bp, Homo sapiens
actggggatgccacgggacaaggctgctggcctggaaggtagtcacgtggagaaccgcaggagatgagattggaaagtagtaataagccatgtggataagaacagaggagcgggttttaagggggacgtcctgaaatgctgctcatgtcgtttcagttccatagaccacaggaaatgcaggtgagagggcagcccggtgggaaggaaggaagagggtggtggtgagccaggtgagtgtggagccgcccagggcaccgtgctgtgcgatagctcaggcatcgggtgcttctgccaaacccttcagcagctggtttggggccaaacgtccttcctgtgtgagagaaggcagagcctaggcagcattccaaaccccatccagatgggaggctgagtgcagagcaaacggagcccagcactccagagccgtgtcccttcactgccatgatcacatcacaaacagcgaggcttggagaggacttaagagctccttcaatgccatcttccatccactgcgtgagccagaatagaaaaaaaggaataagaagaggtcggttaagctctctattaagttgagaaaatgggaacttcaggtgatcatgtgagatattcaagttaaaaaaattatttaaaaagcacattcttattattaaaattttagaaagtacagagaaggaaattttaataacctacacctagaacactaagatactggtaacgtagaaaaatgtgtagttaatgccttgatggattcttttctatttttttctctagcaatatttatgtctatccacagaaagcgtacactcatgtatttgcatggctaatatattttatgtaaagttctatatatttctcaacatttcacttaatatttctttataaacatttttccagtgaataaaaatttttccaaacagtaaaaaaaaga

SEQ ID NO: 8765 - DNA, 297 bp, Homo sapiens
tgggaaactggggccttctttgagtactagtgagtaagacattttgcaacagtgctgagtatgaaaggccctggtctctgaaaggctaatgcaaatgttggaaggcctttaaagaagatgccaagccacagtgagtgccagctgctagctctgaaatagtgatgtgaaaaggtagatttcttttgtgctatatttgtgctaagcagtgcctttaaaaatataactagaatcattacggtgaatagacacagaaaataattttatgttatacagtagttgtatactagcttcctttaa

SEQ ID NO: 8766 - DNA, 1216 bp, Homo sapiens
tttgatacataagctgatgtctttggtattttacttttgtcagggagaattgaaggcggcatttgactcatctaggggcacagttggttttttgaagttgccgtagtacagtttgattagttataattctacagatgttctgccaaattgtagttttgggctttcttacaatgtaaatccttttattctttaggattttctatagctatagcaatttggtaggagctagcattctgaataaatattttataaaaaatgttagtagcaaaatttgagggagaacattctctttgactgtctatctggcagctttcttgctttggtttttctctgtgccaagacaaccaatcagcatctgctttgcccactcaaccccagttgggcagtagtctaaactgaaatcctggcccgcaggcctccctgtcgcccgcatcctgtcagaactgtgtactgtactcttctcttggttgctgtcgtatctgcatgcttcgtatagaaggacaagtcctttatctaggctgtaggagccagggtgcagattgtgatcctcttgaatgaagttctggaggaagtttctcttgagacagtatttctaggtccatgttgacatgaaatcatctgatgataaaatggtgacgattcagagctctgttaccatcttaaagatggactcggagaggaaggagaactcgtgtcccctgcagggggttcgtgggcaggtgtccccgtcaggcccgcgggctggaagtgtcgctgctggggatgaaagcagctgctcctctgcacgcctgctggtttcctccttccacgcttcctttctcactttggacacctgattctataggccatgtgcaggctgtgtatctggtgtgtcccctgatagctctgcaggtttgatggaattcatcccagggtgcgttggccacgggtgatctaccaaaacagtttgagttttaaattatccagtgcagtggttcctagactcactttgtgcatggaggcagccccctcttcagatggagtcttagataaaatgagtgaattcactgggtgggcagctgaggctgcctcagagtcttcagaggaaggccttggcctccaaccccacaactctaaggttctgagaaggcagaatgctaaactcgaccaacttttgattttcttttcaaagtacactttttcccccccaagactctgtctcaaaaagaaaaaaaaa

SEQ ID NO: 8767 - DNA, 1237 bp, Homo sapiens
acccccaaaccactctgcatcctccccagcctcgcagactgctggcttctccaagccatctttccttctgtctgtctcctctgctgagctccatgtgccgctccttctcctccccattctcccgtttttctgtcctcagaacaccgtcgaagacgatgttctgccaaattgtagttttgggctttcttacaatgtaaatccttttattctttaggattttctatagctatagcaatttggtaggagctagcattctgaataaatattttataaaaaatgttagtagcaaaatttgagggagaacattctctttgactgtctatctggcagctttcttgctttggtttttctctgtgccaagacaaccaatcagcatctgctttgcccactcaaccccagttgggcagtagtctaaactgaaatcctggcccgcaggcctccctgtcgcccgcatcctgtcagaactgtgtactgtactcttctcttggttgctgtcgtatctgcatgcttcgtatagaaggacaagtcctttatctaggctgtaggagccagggtgcagattgtgatcctcttgaatgaagttctggaggaagtttctcttgagacagtatttctaggtccatgttgacatgaaatcatctgatgataaaatggtgacgattcagagctctgttaccatcttaaagatggactcggagaggaaggagaactcgtgtcccctgcagggggttcgtgggcaggtgtccccgtcaggcccgcgggctggaagtgtcgctgctggggatgaaagcagctgctcctctgcacgcctgctggtttcctccttccacgcttcctttctcactttggacacctgattctataggccatgtgcaggctgtgtatctggtgtgtcccctgatagctctgcaggtttgatggaattcatcccagggtgcgttggccacgggtgatctaccaaaacagtttgagttttaaattatccagtgcagtggttcctagactcactttgtgcatggaggcagccccctcttcagatggagtcttagataaaatgagtgaattcactgggtgggcagctgaggctgcctcagagtcttcagaggaaggccttggcctccaaccccacaactctaaggttctgagaaggcagaatgctaaactcgaccaacttttgattttcttttcaaagtacactttttcccccccaagactctgtctcaaaaagaaaaaaaaa

SEQ ID NO: 8768 - DNA, 465 bp, Homo sapiens
ttttttttttctttgagatggagttttgctcttgttgcccaggctggagtgcagtggcgcgatctcggctcactgcaacctctgccttccggtttcaagggattctcctgccttagcctcccgagtagctgggattacaggtacccgccaccacgctcggctaatttttgtatttttagtagcgatggggtttcaacatgttggacaggctagtcttgaactcctgacctcgtgatctgcccgtctcagcctctcaaagtgctgggattacagggcctctttttcttaactggacaagaattccttcaaagtttttggtaatgtactttcaaagcaagccctcccaaataatggggtgacaattcccactggaggttaccttcccagtgaccagaggctaactgtatctcttgtgtttggggcagggtagcaagaatggtgaaggagttgaaaccctactagggg

SEQ ID NO: 8769 - DNA, 453 bp, Homo sapiens
taaatccatgcatacatggtcaactggtcatcacaaacggtgccaagaatacacaatgggaaaggatagtctcttcaactaatgatattgagaagactggacgtgacatacaaagcaatgaaactggaccttatggcatacacaaaatatcaattcaatattattattttacatttaaagatctgaaactgtaaacctgctagaagaaaacatacatgaaaaaccacttgacagtcgtcttggccatgatttcatgggtatgacacaaaaggcacagggaacaaaaacaaaaataagtaggactacatcaaaataaaaagttcatgcacaacaaaagaaacagtcaactgagtgaaaaggcaacttactgaatgggacaaaatatttgcaaaccatatatcagatacgaggttattctccaacctatacaaggaattcctactactcaatagt

SEQ ID NO: 8770 - DNA, 181 bp, Homo sapiens
ctcattctctaataagctgctcctctctagttatcaaggtagaatgatctgataaactaattgatgctataagtgtcatgggatatgctgccagggttatctacttcagcagtagcctcttcccagacaaagcaaaggtactcgaaagaggattctttagtgatagaatgacacacactac

SEQ ID NO: 8771 - DNA, 412 bp, Homo sapiens
cgttcctcacactgtggccacaggacagaagtcgaggctcaggcggggggcctggtaaagactttgggtttttcttgggacccccaaagttctatcccctaaaagcaaaggtaaaccagcaacagaattgtctttgtggggactgaagccagccttaaatcacctcaagccctgagagaattaaggtgagccgctcaccgggacacctgtggacagaaaagtacaccttccctggaggaaggtaaaacaaaacaaaaacagacagaagtcctcactgcacggtgctggaatggatccgggtcaggaaaaattattacaaagtgcatgatggggacattcacaatttggaatatgccttgtacattgtgcaacaaaattctaccaatgataaactccagaattttttttgttt

SEQ ID NO: 8772 - DNA, 325 bp, Homo sapiens
gtacaggtagaatgtgtgcatcctctcatctgcctgtgtcttcattggaaaacacctgtgctagcctttatctgtgtctgcaagtgaatatttgaggtctctgctctatttattttattttatttatttatttttgagacagagtttatttatttatttatttttgagacagagtcttgctctggcgcccagcctagggtgcagtggcgacatctcagctcactgcaacctccgcctcccgggttcaagcggttctcctgcctcagcctcccttgtggctgggatacaggcacctgccaccatgcccagctgatttttgtatttt

SEQ ID NO: 8773 - DNA, 388 bp, Homo sapiens
ggttaagttattttgcttatttagtagcaaccacactctgataagagtattctgcccatttcagaaatgacgttttttaaaaacttatctaggaaacagagaccaaaggcaataaaggatgaaaggctaaaagatcatcttctctatgaagaaagagatcacacaaacttcagttattaagcttgaagaagagacagcttagaggcacctaaatcattatctttaattccatgaaaatgtatactgcatgaaagatggtgaccagatgtttctcatcacttctgaggagaaaataaacagaaaaagccttgaacttcagcaaaagggctctgagaggccatgttcctgagctagtccagtaagtctcagattttaatgcacacgtgag

SEQ ID NO: 8774 - DNA, 422 bp, Homo sapiens
aaaaattttaaaaatcagccaggcatggtgatgcatgcctgtagtcctagcttctcaggaggctgaagagggaggattgcttgagcccaggtgtttgaggttacagtatgctatgatcacagcactgcactccagcctgagcaacagaactcacatctgtaatcccagaactgtgggaggccaaggcgggaggatttcttgaggccaggagttcaaggccagcctgggcaacatagagaccccatctctacaaaaaaaaaatttaaaaatataattagttgggtgtagtggcacgtgcctatagtttcagctatataagaggctgaggcaggattgcttgaccctaggagtgtaaggcttcagtgagctatgattgaaccactacagtccagtctgagaaagaccctgtctcaaaaaaaaaa

SEQ ID NO: 8775 - DNA, 345 bp, Homo sapiens
aataaaccccatgtgtcaagggtggggccaagtggagataattgaatcatgggggtggtttccaccatattgttcttgtggtagtaagtctcacgagatctaacggttttataaatgggagttctcctgcacaagctcttttcttgcctgctgccgtgtaagacatgcctttgcttctcctttgccttccaccatgattctgaggcctccccagccatgtggaactgtgaatcaattagacttctttgctttataaattacccagtctcaggtatgtctttattagcagcatgaaaacaaacagacgcatatgggaatctaaagtcaagggccaagaaatctgtg

SEQ ID NO: 8776 - DNA, 353 bp, Homo sapiens
aaggaaccttggctgcctcaccccacaggtcgggcagggccacctggctgggaggtgccgggaaggctgggccctcactcctgaccgccagctcacaccgccgcaaagccatctccacaaggtctggctacaacacggagggcagactcaacagagaacagtgttgttaccatgaaaatgacaacctgtctttggaggaggccccgtgccactgagcatccagaaataaaccacaacatggacaggcttagaacaacaaggaaagctgccaggtcagaagagaaaaatgagccacaggggtcggataaggctcacacacgtcctcagctaaaaagggcaggaacagaaccttc

SEQ ID NO: 8777 - DNA, 409 bp, Homo sapiens
cctctagtgattctcagaagaactacgggatttttctgtgaacccagcaacttagtttcttagactgcagtaaagaagtgttgaaggcaatggggtggatttccaccagaaacaggctacagaggaatattccagagaagataccaggagtatgttttcagccttatttcatattttacagagtgcttaccattgctaacaatgaagatatagcatggatggaaaccctattgtcactcatgataacctaattcagagcacaatatttactgaaaataggttgatagtcttctggattttaaagtgtggttctccatccctttttttctggttttattttgtcactagcagttagccactaggtgtcagtagcaatccaacatcacaatacaaattgccaactctgaaa

SEQ ID NO: 8778 - DNA, 1385 bp, Homo sapiens
tggaactacaagcatgcgccaccatatgcagctattttttaaatgttttgtagagatagggtcttactgtgttgctcaggctggtctcaaacacctgggctcatgtgattcttctgcttcagcctcccaaagtgctgggattatacgcatgatacactgtgcatgaccagaaaatataaaacttttaaaaagagcattgtttcatatgttggaatttgactaatatttctctttttgaattctgtgagtatataactgatacaatttttttcttctattatgaccagtttcttacctaagcaaaaatgtatgaccagttggtttgtataaggttagcaataacttaggggtatattctcttcctgcatcccagtgcacagtgagttgtatatcacaaatagagccactcagatacttgggccctaacaactggcagcactaccccaagtgatataccagatggcttgcagagtgttgtatcagggtagtccattattcatagtgtgtgtactctttgtgttgtttttttttcctccttattcagccatgaataagggtaccatgaactacctatacccagctgcctggtgtgtctgtaataagcagagcagcctgtgagattaggagcctctgggatgggacgaggtttgtttctgagcctttgctactagcccattcaatgctggagcacaatcagaggccagttttactgttagcctttcctagagaaactcccctcttccttcacagttggtccagaggttatagttgtgttcagatgtgtagaagagagcccctgcggggagaaagtccgtcccatcagctaagtctagctaaagcctacttcatgggttcagaagacattaatggttccacctgtttctacactgcagttctaaggatgctgtattgatcagaagtagtagtagcatgatggttttccaataatcagttctgttttcagtggaaaaaatgcttttgatttatttagggtctggtatatatttttcatgtcagtttacctaatatgcatgaaagtgttttaacatctatgtatgtctttacagaagttagttgtagctggttccatatctattgtataaagaagtattaacagaataggtttgcttgcattattatactttcatcaatgtgacagtttacttggatttttgttttcagaaagtggtattttcatacttgtatctaagtattacgttgcattagacaaagtgtcttccatgaagataaactgccatcttagctaatttggaacaaccaagtcctattaatataaatagaaaatattgacacaaagaattcttttcttatttagttggttatttaatttaaagattaatatttttaccttatggaaagtttgg

SEQ ID NO: 8779 - DNA, 1110 bp, Homo sapiens
ttattcgtgttgcaccatgctcagatcaagtaacccaggtttccagatatccaagggaataccctggaactcttaatggtccttggaggaatcattaaatggcctcttccctggactcattgaaccagcagtaactcctaagttggatggatctcaatcttgatttcaattcaggtctctaacatttgagtacttgcttttcatgtaggtgctcaggatctgctatataccatagattttaaggtgacttgttgagactgagaaaagaaatgtctaacgaacagtattaatgcagtcttaatacaactcaggacctatgtgacctttagtttctcatcagaaagggaaatttacatgttattgcctcataattatgagccagccttttgtagggctaacagtgcatttgaccagctataaatgtggcctccagatattatgtcatatttatagaagttattttttaagtgcaatcagtcattgcctttggtagaaggaagttccctttggagtgttgtactaaactaggcagcatggatggacaaatgaatttcccaagggcttcaactactagaaatcatctggtaatataagggctggccccaaagttttttaaatgaaaaaagaagcatgaaggttgaaagaataagaaaaaggaaaatattatataagtataaatggatttatgacatggcctgcatcagagatttagtattgttttcctaattcttatacattagactaacatgcacagcttctaatgaagaaacacaaatgctctcctgcccctatctatagttccagatccgtttttgtggtcccagaatgaaggcaaataaaacataacatacacagcattaaccataattttttacacggccaaaacttcacctcaagatataatagagaacatttttggtattttccatgggtggcttagaaacatgcctttattattgtcaataagacttacctgctagactaagaccttaccctctttttgctgtggattcagaattttatgactatacattatctgttctttattatatactgtttgttttatgctagacactaatcctttctggagcagaggaagaaacaggaatg

SEQ ID NO: 8780 - DNA, 447 bp, Homo sapiens
ccatctgcaattcctaaggttgagctcaatgcatcacatgtagtagatgttcaagaaatgtttgttaaatgggcagttgtaaacagagacagtgccgtgtttatttcgttttccagaaaggcacctgactccttgctttgcacataacaggtgctcaagaaatgttgaagaaaaaagcaaattgctttgaatgcagtgtatcctaaaaccagatttccaggttgccccagtactctgtacaggcctccattttggctgttaacacagtgtatcttttgttacattaaaatgggtccacgtttgcatctcctccgaaattataaactcctgggagtgcagggatgtgtctcatacattcttccttgacttttccacagcataccttagcacagagttggatatgtagtagatgttcaatggagaattactgaattttcttaaaaaaaa

SEQ ID NO: 8781 - DNA, 285 bp, Homo sapiens
ccactgcccaccaactgtcatgcctgactcagtgagaaccctctcacttgctctatgtttacccagtgattgccaggaccaggtgagaacaagcttgttaccgttttctattactctattaggaacgatcttcatctcatctttctcttctttaacctgtaggtgttcacattggtaggaatgcaccactgaaatcatcttgaggatgcctgaggtccacatggccagctaggttctcctgttatcagggaaggcagcttgaggcttttgcagctctactccaac

SEQ ID NO: 8782 - DNA, 527 bp, Homo sapiens
gatcttaaatgcttttaactttgaacttgtgacaataatgtgctattaatttcttcatccagttttatcaggatacagttttctgatagatgaagcttattctctagattgtcagtaccgtttatttgaattatttaatgaagcttagggaacaaaccccaaaatttcccaccttactagcctaatttgaattttttaaaacagcttaattaaaccatcattaaacatttataattgctggctgggcacagtggctcatgcctgtaatcccagcactttgggaggctgaggcaggcagatcatttgaggtcaggagtttgagaccagcctggcccacgtggtgaaaccctgtcccttctaaaaataactatatatatatattagctgggcattgtggcaggtgtctgtaatcccagctactcaggatgctgaggcaggagaatctcttgaacctgggaggcagaggttgcagtgagccgagatcgtgccctgcactccagcctgggcgacagagcgagacttcatct

SEQ ID NO: 8783 - DNA, 644 bp, Homo sapiens
  misc_feature (594)..(594): n is a, c, g, or t
  misc_feature (621)..(621): n is a, c, g, or t
ggaggaaggattccaccagtaaggaggcaacaagaggtctaggcaagatatgggagttgacagctggtctaggctgttagtggagaaactgggaagcaacagctgggtcaaaagtagcttttcttttcttgtctttgtcttttcttttattttctttttaagacagggtctcgctctgtagcccaggctggagtgcagtggcacgatctcggctcactgcaacctctgcctcccgggttcaagtgattctcctgcctcagcctcccaagtagctgggattacaggtgtatgccaccatgcctggctaattgttgtgtatttttagtagagcagtgtttctccatgttggctaggctaaaaatagctttatttctgcctcgttttatgttcaggtcccccattagacagaggaaccaaggccagaatgaggcaggggcactggccaattgatctcccaagcacagtgaatctgaatggttgtagagttgtgtaatggatcccactgaggtgatcagggcccaaagtggagggtagatggccaggttttaacaaaagagggaatagtagttgaggctgaggttgcagtgagccgancctacgccattgcactccagcctgggnaaccagagcaaaactccatctca

SEQ ID NO: 8784 - DNA, 397 bp, Homo sapiens
gggacagcccatatccatggccctcagggtcaggctaagcacatcccagcccagcccatcctgcctggcctcttggggccaggcctcacagagcagaggggtgtgtcctgggcggggggaggtaggattctctttttcctttctgccagtgagtcactcatagcggtgagagtgacctcccaatgacacccgcccactgtggcctgggcaccgagcctgggggatgtgggcagcacagatggagacagcagcctgggcaggatggccagggagcctgggagatggacacacgtacactcacacccacagtcctcttgtcacacacacacagagactcatcctgacaccaacacaggttcacataaacattcccatacatttggccgggcgcagtggc

SEQ ID NO: 8785 - DNA, 625 bp, Homo sapiens
acagttcctagccttgtagagactgatgaatcaatcaaagagccaattactcaataggtagatggagaatgtgagctggatgataagaggtagaattataagtgattacacaagtatatttaaaacatttaaaaatttctgaattgatgtcactctaaagattagctctaactataaaatcttagaagacaacacaggggaaaagctttatgacattatatttcacagtgatttcttggatatgataccaaaagcccaggcaaggaaagaaaatatagataagttggattttatcaaaattaaaaaaaaaaacttttaggcatcaaaggacacaatcaacagagtgaaaaggcaccccatggaatgggagaaaatatttgaaaatcatttatctgatgaggaattaatatccagaagatttaaagaactcctacaacacaaccaccaccaaaaatcctcatcaaaaaacgggccaaggacttgaatacacatttctccatggaggatacacaaatggccagtaagcacatgaaaagatgctcaacgtcactcatcagagaaatgcaaaccaaaaccacaatgagaaaacaaacaaaaataataaatgttgataagaatctagaga

SEQ ID NO: 8786 - DNA, 464 bp, Homo sapiens
ccaacccctccttatcagttcagtgagggtgaatgagttaatgtcgtgaaagcacttgagttctccaaaacaaagatgttgtgataatattactacagtactttgtgattacaagttagctttgtaaataattaccaatgtgccatatccaatcgtgttctatcttggcctaggagtgttaggatttaccctcatttataagtaagcctgttaagcactatggatgttgagccagggaattaatatagccctcctcttcccaccaaataatctctcctctaggttaaatttctagaatttaaaaacacaatgaggaacctgattagggaacatgggcaaagatgattttttggggagaatgtaagtgtgtttgaggagtatgaatttatggactaaatatgcattttaatagattttgtgattgaagctaatgaaactttccaggactcttttgaaattttcta

SEQ ID NO: 8787 - DNA, 1735 bp, Homo sapiens
gtgcttctaggtcatttcatgttttatagggaaaaagatctttgtacacctcctcaacctgttagtagaaatgttgacttcgattttttgcaccctcttcacaggacctcataagttgcctctgttcttggaaagcaatgggaataaaaatatgctgttgaaaatagtgcatggggccaggcacagtggttatgcctgtaatcccaacactttgggaggctgaggcgggcgcatcatgaggtcaggagatcaagaccatcctgaccaacacgtggtgaaaccccatctctactaaaataaataaaaaaaaaaattagccaggcgtggtggtgcacgcctgtagtctcagctactcgggaagctgagacacaagaattgcttgaacccgggaggtggaggttgcagtgagccaagattgcgccactgcactccagcctggctacagagtgagactccgtctcgaaaaaagaaaatagtacatggagggcatgcattttagtttaggaaacccccctcccttcccagttccagagggagaaattataagctatactgtgccaaaagtgagtggggctgcagagagaatggtgccttttctcaccttctgagttaatgcccgacatctgccattggattcattgaccaaaggaagtcatttctactgtataaactcaggagtatcatagcccaacaagtaaataataaatgttcattggttttggaaggaaggaaaggtgagtattaccccaccaaataccagcgaagagcaccctggctttggccatctttccaaggttcataattgctgtgggcctggtgagccctgttcccaggtatgcaagggagggcttctccaggccagacatttctgtaggttttcaggtagcaactcccccatcatattttgggtgtcattccccactatctctccccacttctcagcctgtgccccagaaacaaccacagcagcctcattctgcagacttaacatctgtcaaataaccttcctgaaaaggaaagttattggaggaatccaggccaaacaacaagtagaatagagccatctaaagttattaataatgagttcagggaaatagatgaattttttcctggcatagtcaatatttatatctcacaacaagtcaaaaataattttccatttggaaaacaaaacacaccatgactgtaattgttaaggcatataatcatgaacttcacatgctccctcaacaaacgttactgctctagggaaatcatagaaaaggaccctcttattccccaggggatcaaagcaagtccccttaggaatttcatgtgtgccatgggtctgtttttatttcacagtgactagtcatatactggagtagctctgttgttcattatttgtaacaggtccatgtaacagtcaagttagcattcaagcaattatggatgtgatactatgatgtacttttgttatgattgtatatgattaataacaaagttatttttcttaaaaaaaaaacaacacaaaaaaaagaaagaaaacaaaaagacaaaaaacaaagaaagacagaaacaaaacaaaaaactaacaaaaaaaaaagaacaaacacaacacaacaccaacaacacgaaaagaacgaccaacggggggacacataaagacgacacaggacaaaagcaaaaggcgagacgcgacaaaaagaagaggcccggcaaaaaccatactcacaaataacaaaaccacaaaaga

SEQ ID NO: 8788 - DNA, 1649 bp, Homo sapiens
gtgcttctaggtcatttcatgttttatagggaaaaagatctttgtacacctcctcaacctgttagtagaaatgttgacttcgattttttgcaccctcttcacaggacctcataagttgcctctgttcttggaaagcaatgggaataaaaatatgctgttgaaaatagtgcatggggccaggcacagtggttatgcctgtaatcccaacactttgggaggctgaggcgggcgcatcatgaggtcaggagatcaagaccatcctgaccaacacgtggtgaaaccccatctctactaaaataaataaaaaaaaaaattagccaggcgtggtggtgcacgcctgtagtctcagctactcgggaagctgagacacaagaattgcttgaacccgggaggtggaggttgcagtgagccaagattgcgccactgcactccagcctggctacagagtgagactccgtctcgaaaaaagaaaatagtacatggagggcatgcattttagtttaggaaacccccctcccttcccagttccagagggagaaattataagctatactgtgccaaaagtgagtggggctgcagagagaatggtgccttttctcaccttctgagttaatgcccgacatctgccattggattcattgaccaaaggaagtcatttctactgtataaactcaggagtatcatagcccaacaagtaaataataaatgttcattggttttggaaggaaggaaaggtgagtattaccccaccaaataccagcgaagagcaccctggctttggccatctttccaaggttcataattgctgtgggcctggtgagccctgttcccaggtatgcaagggagggcttctccaggccagacatttctgtaggttttcaggtagcaactcccccatcatattttgggtgtcattccccactatctctccccacttctcagcctgtgccccagaaacaacaagtagaatagagccatctaaagttattaataatgagttcagggaaatagatgaattttttcctggcatagtcaatatttatatctcacaacaagtcaaaaataattttccatttggaaaacaaaacacaccatgactgtaattgttaaggcatataatcatgaacttcacatgctccctcaacaaacgttactgctctagggaaatcatagaaaaggaccctcttattccccaggggatcaaagcaagtccccttaggaatttcatgtgtgccatgggtctgtttttatttcacagtgactagtcatatactggagtagctctgttgttcattatttgtaacaggtccatgtaacagtcaagttagcattcaagcaattatggatgtgatactatgatgtacttttgttatgattgtatatgattaataacaaagttatttttcttaaaaaaaaaacaacacaaaaaaaagaaagaaaacaaaaagacaaaaaacaaagaaagacagaaacaaaacaaaaaactaacaaaaaaaaaagaacaaacacaacacaacaccaacaacacgaaaagaacgaccaacggggggacacataaagacgacacaggacaaaagcaaaaggcgagacgcgacaaaaagaagaggcccggcaaaaaccatactcacaaataacaaaaccacaaaaga

SEQ ID NO: 8789 - DNA, 1425 bp, Homo sapiens
gtgcttctaggtcatttcatgttttatagggaaaaagatctttgtacacctcctcaacctgttagtagaaatgttgacttcgattttttgcaccctcttcacaggacctcataagttgcctctgttcttggaaagcaatgggaataaaaatatgctgttgaaaatagtgcatgggggcatgcattttagtttaggaaacccccctcccttcccagttccagagggagaaattataagctatactgtgccaaaagtgagtggggctgcagagagaatggtgccttttctcaccttctgagttaatgcccgacatctgccattggattcattgaccaaaggaagtcatttctactgtataaactcaggagtatcatagcccaacaagtaaataataaatgttcattggttttggaaggaaggaaaggtgagtattaccccaccaaataccagcgaagagcaccctggctttggccatctttccaaggttcataattgctgtgggcctggtgagccctgttcccaggtatgcaagggagggcttctccaggccagacatttctgtaggttttcaggtagcaactcccccatcatattttgggtgtcattccccactatctctccccacttctcagcctgtgccccagaaacaaccacagcagcctcattctgcagacttaacatctgtcaaataaccttcctgaaaaggaaagttattggaggaatccaggccaaacaacaagtagaatagagccatctaaagttattaataatgagttcagggaaatagatgaattttttcctggcatagtcaatatttatatctcacaacaagtcaaaaataattttccatttggaaaacaaaacacaccatgactgtaattgttaaggcatataatcatgaacttcacatgctccctcaacaaacgttactgctctagggaaatcatagaaaaggaccctcttattccccaggggatcaaagcaagtccccttaggaatttcatgtgtgccatgggtctgtttttatttcacagtgactagtcatatactggagtagctctgttgttcattatttgtaacaggtccatgtaacagtcaagttagcattcaagcaattatggatgtgatactatgatgtacttttgttatgattgtatatgattaataacaaagttatttttcttaaaaaaaaaacaacacaaaaaaaagaaagaaaacaaaaagacaaaaaacaaagaaagacagaaacaaaacaaaaaactaacaaaaaaaaaagaacaaacacaacacaacaccaacaacacgaaaagaacgaccaacggggggacacataaagacgacacaggacaaaagcaaaaggcgagacgcgacaaaaagaagaggcccggcaaaaaccatactcacaaataacaaaaccacaaaaga

SEQ ID NO: 8790 - DNA, 483 bp, Homo sapiens
ctgcaaattgattctttttcacatctatttccttgtcttgtaacttttaccctttaccttttatgagatgcagaaaaaccctctcggctttgcattagcacccgtgacagatcctgttgatccaccactgatttttagcctgaactgggatggacactccacaggagctcaggctctcctcctcctgtttccatcttgctccttcccaccttggagccttcgccagcaccatggatgtcccctcagccttcatgcaaatattccccaggtatccagaagttactgctcagggaacacttgcaggcagacaagctctccagcctcctgtccttcaggggacaaatttgggaggcattctgtagacctcctcagaggtccagaggaatcacaccagtggcctcaatactgtctctcctgctggcttctcctggtttcccatctcactgtcccctctccttcagatctgcttcctgggatcacctc

SEQ ID NO: 8791 - DNA, 328 bp, Homo sapiens
tcagaggttacaagcaaagtcataaatcaatacgtggacactgtacattattttgacctaaaaaggtaggatggacatctcagagaaggggcttacaggtcataggtagattcaaagattttttgatttgcaattggttaaggaggcaaagctttgtctgaaaatttgggatcagcagaaaaaaaggttagctctggcttgcgggtgtgacttcttccaggccccacaggaagaactttagaacaaagcagcggttggagttcagtcctcagttccccattatctgaggtcttcagaccagtggatccatttggtggaggtatgggtt

SEQ ID NO: 8792 - DNA, 334 bp, Homo sapiens
ttgccaaccccagctatatgagtcaatcagacacaatacacactgagacccaaagtcaccatatgccccttcatttggtacctcattcattccagtaggtctagccccctgcaggtgaaggtctttacttttaaaagtcagttcatgaattttggaggggatgactgcttcttcaaatgcatagacacctacacaaagttacaagaatcacagagaatcaggaaaacatgacgccaccaaaagaacacaataaacttccagtaattgtcctcaaaaaaatggagatccacaagttgactgaaaaagaatttgaaataattgttctaatgaaatt

SEQ ID NO: 8793 - DNA, 498 bp, Homo sapiens
gggaatgaatttggactcctacctcatatcatgtacaaaaattaaccgaaaatataaaagttaaaaatgtaaaactcttaggagaaaacataggttgaaatcttcatgacctcggactaagcagtggtttcttagacgtaataccaaaagcacaagcaacaaaagaaaaatagataaactggacatcatcaaaataaaaaacttttatttatgcttcaaagatactatcaagagtgaaggccaggcatggtggctcacgcctgtaatcccagcactttgggaggctgaggcgggcagatcagttctgtccaggagttccagaccagcctggccaacatggcgaaaccccatctctactaaaaatgcaaaaattagcagacatgttggcagacacctgtaatcccagctacttcagaggctgaggcaaggagaattgcttgaacccaggaggtggaggttgcagtgagccaagattgcaccactgcactccagcctggg

SEQ ID NO: 8794 - DNA, 421 bp, Homo sapiens
cattctgaatcagcttatgtaacttgtccaaggtcagtggtggagctaatattttagttgagattaccttcatcaagacatcatacttaaccacaacactggttaaaccatggatagcttatgattggcttcatagccttacactcagttacctatgctgtccctctgcactctgcctactcttttacttggttgtgtcccttatgcctccaaatatttatgctactcattgactataaatgatagttgagcaggtttctttaccacaaaactctaacacttttaaatattagtattgaaaacttcaagaatctgttgtaggtgttcacaggattgtttgtctatattttatcccccacctccccagctgtctttcatagaattcatcccttttctcatctccttcctctcattgtaatac

SEQ ID NO: 8795 - DNA, 371 bp, Homo sapiens
agcactgaatgataagaagggataagcagttgaataatttatcaaggatgctggtgtagctaaatcaggagacaagtaggataccagtaggtaacatgggtgaagaactagggaggcaagagactgcatacaatcttacagatcaggagaaagggtctggattttactctaagtgtaaagggaaactatgggagagatttaagcaaataagtaagacaatattttacttgcaatgattaccctcactgctgtgtagagaatacatgtagaatagaaacaaggagactagtaatctcaggccaagagctgaggctggcttagacttatactacatttagcaagagtaagattaagatcttttaaggcgtgtt

SEQ ID NO: 8796 - DNA, 217 bp, Homo sapiens
aagaagctattctagcaaagctggaggaattccaccagactgacagaacaacacaaataagtccatgcctgacgcacagcaggggctcaaggcaagtttgtggactcgaagccctgttagaatggatggaatttggtcttatgaagcagatagaagaacaggagcttgactgtaaagatttgtctccacctcttaataaagcatatcatctccaaga

SEQ ID NO: 8797 - DNA, 423 bp, Homo sapiens
gctggtgagatccctcaatgggcccccctctgtgggcaccaggtccggcaactgtgctgaaggaaaacccacatatgtccagcgtgcggctccatctcccatactgccttgcactcaccttccctcccctactgaggaggaaatgagtgtctactgggcacccccttgtacccagcatcatgccaggagccttcagtaactggtgatgcatcccccaccacaaccctgggaggcggacaccgtgatgatctctgtttgacagatgaggggactgaggctaagagaggttaagtgacatgcccaaggtcacacagcaggcgcacggcagagccaacaccatctcctggcccacgatggttctgtgtcccctgacgcagcaggtgcacaggcgggccccccacctgctcctagctgggccgggtc

SEQ ID NO: 8798 - DNA, 938 bp, Homo sapiens
attctagttggtgtgaaataagaggtgcgtgatgagttggagcattactgcagaaaacatagccccatcttttccctgtgaggaatgggcatcccacaggtctgaattccctctggggccctggctgcagctatggctcaaggtggatgctgtttggccccacccgagccctgggaaggtgatgctcaggctctgccaccgtcggcaacactgaggatacgcagggatgaggtgccctgatttggggaacattacccttaagatactagtgtgatgtcattccacttcgcagtggggggccccagctttcaggccagcattgaggacaggagccgttgccatgtgaaaaagttattttcccaaacaatgaacaatcctcatgatgtcatgggccctgccagaggcccaaatccaatcggttctggtgctggggcagcctcctgtaacactatcctgagaggatgactccgcctgggttggggacagagagcagagaggccgggggtcttcaggtggggcccctgcatgtgtctgcgttcacatttcaaagtggctttcactcagaggaaggtggagcttagcaaagaattgcgcagatcaaggagcagcagaaatgggggcctccccctgcaggagcagcccatgggtcagaagtggggctggcatcggggtgagccaggacatcccaggatggaagaactaaatgaatggccacagaacggggatcactggagcaggaagtggcctcccccatgcgccttcacgcctggctgaaatctaatcctcattcttgggccctcatgtcacggcccgggcctggcttcccagcagcctgatgcagccaagctgttcccactcttctctcttcctccagaggaaggacctttgccgatgaagtcatgggaataaaacctccctctgccctgaaaacagtggga

SEQ ID NO: 8799 - DNA, 1004 bp, Homo sapiens
aactgaaaggttgggattaagttttggtgccagcttaaatcttccccaggctggagacccatagcaggacaacaataaaattctagggcagtgtttaattttcagtgctcactgtaagcctaccctagaggaaataatagcaagtcaaggagttagttccagggaagtgttttagttccagtactcatgtaaatcctccccagaatgggaaaaaaacaacagcccagcatttaagttctgatactaagtagtaaatctctaacaccaccaaagagcacttgcaaaaactggaagaggtagccaactcctcaaatgaaccatcatcaatgtaaaaatacaaggattgtgaaaacatggagaaataggatactaccaaaagaaaccaacaaacctccagcaatggacgcagaagaattgaagatctatgaaatgttgtacagaaaattcagaataatcctgttaaagaggttcagggaatcacaggaaaatatggatagaaaacaaaatgaaatttaaaaaataatccaggatcacaatgagaaatttgtttcactgtatcttttatttttatctttgtatcttttatttttatcttttataaataaaagatacaaaccttagaaataaataatacagtaagccaaaatctcattagaaagttttgattgaagcaaatttgatcaaacagagaaacttagtgagcttggagatagaccatatgaaataaccctatcagaggagcagaaagaaaaaagaatttaaaagagtgaaggagacctatgagaattatgggataccatcaagtgaactaacctctgtgtaatagggactcctgaaggagaccagagagaaaaaggcctagaaagcacatttaaggaaatagtagctgaaaatttctcaaatctggagaaagacaacaccatccagctacaggcttagaggtaaccaactatattcaatacaaagaggaaatccccaaggcacatcataatcagactagcaaa

SEQ ID NO: 8800 - DNA, 613 bp, Homo sapiens
aaggaaaaaatgcctaaaagcaaagataatatgagggtagccatggggaaaacataaattggcaccaaaatccttgaaaagtatcctaacccatgctgtttcacgtttacactttactcaatttacctttatcagaggggccagaaacaatcaattcaacttcattgaccctataatttacaaaggaatagcgtatgtattggctttggggtttctaagaaatagtaaaaggataaatagtgaattggtcacctaatcgggaaaggtggttccttggtaagatgataatttcaggtgtgaatgaccacagtgtattcctctgcccactccttcagcctcatagcctcagcaaggtggccacttcaatagaaccctgcaaagtcagagggcctgagttcaagccctaacgcctttgtctctctgatttacccactctgacacaaggcaggcttctcacttctcagagtgtttcctcattaggagtctgataataattcagatattacctcccaagggaaaagaggaaataatatatacaacaatgctttatatagtataccttgatatccctaaatcattatatttctggatgcttttcctgaagcaaatgttt

SEQ ID NO: 8801 - DNA, 365 bp, Homo sapiens
tgtagagacagggtctcatgatgttgcccaggctaatttcaaactcctggcctcaagtgatccacctcagtttccctaaaaatgtgctgggattataggtgtgagccaccactctggccatagatacctacggcaatgtttgctgccatcatcctattcttgttctaattcatctctccacactgctgccagagtgggctttatagaacacaaccctaatcatgccatttctctgcttagtggtcttagctggtccccatggcttacccaattaagtttagtggtcagaatcaaaaggataatcccctagacctatgcaccattgtcaatcccttcatccctgaatccagaggaagctggtggtc

SEQ ID NO: 8802 - DNA, 374 bp, Homo sapiens
gtccatgcagatagtgtctgctgggttacctctgctgatttccttttctctttctctattgaggagtctgtgacattgaaaatggtgcttgaggctgggcgtggtggctcacacctgcaatcccagcactttgggaggcccgaggcgggcggatcatgaggtcaggagatcgagactatcctggctaacatggtgaaaccctgtctctactaaaaatacaaaaaattagccaggcatggtggcgggcacctgtagtcccagctactcgggaggctaaggcaggagaatggcgtgaacccaggaggtggagcttgcagtgagccgagatcgcgccactgcactctagcctgggcgaaagagcaagactccatcta

SEQ ID NO: 8803 - DNA, 263 bp, Homo sapiens
ccgccagcaggctatccctggcatgttctaatgctgatggcaaataggaagagcacaaagagaaatacacaaagccttttcaagtctctttccaagtccatttgctgatatcacattggccaagtcaagttacatggctaagccaagcatccaaaggtgagtcaggatgcagagtgggaagacattgcaaattacatggggccatttttgctctctgccacaagagctgtggtctaggtgcctgtgacttattgccaagtccc

SEQ ID NO: 8804 - DNA, 963 bp, Homo sapiens
cactgcaaccgccgcctcctagttcaagtgattcttgtgcctcggcctctggagtagttgggagtaccagcatgcgccactgtgctcagctaatttttgtatttttagtagagacggggtttcaccatgttggtcaggctgttctcgaactcctggccttgtgatctgccccccttggcctctgaaagtgttgagattgcaggtgagagccactatgtctggccatatttaagcatatttatgatagtatcttaaatttaagtgaagggaaagaggaaaacatacacagccaatgaagtaagtttgaagtggagtgaaaggaaaagttggaggtaaaaagaggttagagaggtgggcaggggccaaatcatatagggcctttaggacatgggaaattctttggatttgttctgagattagaagtcatttagatattctttagaaagggaatgacatgatctgatattaaaaaaaaaactagaatcactgtgagtaggagtagatctaattccattctgactaaatagtaaactaatatgataatttggacaaatataaaaaggaattcctggctgggagcagtggctgatgcctgtaatcccagcactttggaaggccgggcaggtggatcacttgaggtcaggagtttgagaccagcctggccacatggtgaaaccctgtctctactaaaaatacaaaacattagctgggcgtggcagcaggcgcctataatcccggctattcaggaggctgagataggagaatcactttaacctgggaggcggaggttgctgtgagcagagatcgagccattgcactccagcctgggagacggtgcaagactcaaaaaaacaaaaaaaaaaaaaaaaacggaaaggatttcataatattaatttccttgacttagtgacttctgcctattttatttgaagtcattggttcttctcttctcttctcttgaga

SEQ ID NO: 8805 - DNA, 371 bp, Homo sapiens
aggggctctagaatgggaattctggccccaaagtggtagtgcaccagattttaataggcaggcttgaggagatggtgtctgatttatgtaaggcccaagattggctggaccaggtgtgatgtttacacagcctgccgggaagactggaaggctagaaatctcaccctaatctttttttttttttgagatgaagtctcgctctgtcacccaggctggagtgcactggcacaatcttggctcactgcaacctccgactcccaggttcaagcaattctcttgcctcagcttcctgaagctgggactacaggcacacactgcaacacttggcgaattttttgtattttagtggagatgaggtttcaccactaaag

SEQ ID NO: 8806 - DNA, 206 bp, Homo sapiens
cctcaagggtcgacgctttctccccagcacccttaattcccacggcagttcattagctatccagcagcagagtcccaccatggtcattagttaattttatttaccaacatatatctagctcctggcatgttatgtgggaaacagcagggatgccaaaacatggttgtgaaataaatgaaagataggagggagacaaacagagagta

SEQ ID NO: 8807 - DNA, 1268 bp, Homo sapiens
  misc_feature (608)..(608): n is a, c, g, or t
  misc_feature (1187)..(1187): n is a, c, g, or t
catggtggctcacgcctgtaatcccagcactttgggaggctgaggctggtggatcacttaaggccaggagttcgagaccagcctggccaacgaggtgaaaccccatctctactaaaaatacaaatattagaactgggtgttgtggcacatgcctgtagtcccagctactcgggaggctaaggcatgagaatcgcttgaaccccagaggcagaggttgccgtgagccaagattgcgccattgaactcctgcctgggtgacagagcaagactctgctaaaaataataataaaaataataataatagaagtacatacataaactttaaaatgtaatagaaattatattttgtattcacccttttcccctctgtgaatgaagaagtccaaggccagtcacgtagtacttctgcaaaagaggttatgaatgaatttgtgggacttgttgaaatttcacaggtgagatcctacacagatggagaagaaaatgaggcaagaataggattttggaaacttgcctagaactttcaagattcaagaatcagaaatgataatcaaagagataggagaattaagagtttagtgtcaaactaagaagagtgaattcaatgntaatagacaattcttgtaaacaacatgtcggccgcttgggccagccgatttagactgagcaagctatgcatgcgtccgaattgagctcactcgccaatcggcctatggtgagcgaatacaatcaatggccgcgtttaacacggtcggattggaaacccctgcgtagccaattattgcttggagaaatccctttccccggttgcgaataggaaagtcccaccgaaggccttccaaaggtgcgacctgaagggatggaatgtaggcgtaaaatggtaaatccggtaaaatggaaaacaccattttaaacaggcccaacggaaaatcttataaccaggattcccccaaggggtgaggggtccttgtacaaggccttttgagacgggtcctcttaaggggaaaacgttttggggggcccctggcaccccctattttttggggggcctaacgaccctaaggcccttttcgtggtctaactcttatcctaaggggctaatcaggtgctcctgggcctccaagggacgggaacatcacgcgtcttgtttacggcctctgctgtttcacatcggtgaccccgaacantcttgtctctctactatcacgatcggcagcacgcattatggccgcatctcccccctaccgtccgtcctgttgtttcatccc

SEQ ID NO: 8808 - DNA, 1045 bp, Homo sapiens
tgtttccctttgtctatattttaaagcacttgatagaaaaggcgtatgcaaggtttttccaaacaatttttctgtttgtttgtttgataactgacaacaatttgaattccaagaaaaaaaggaggaaaaattttgttcggtgttataaagaggtagagctggatgaagactaagcatttaaatactaagttgagggcatagtagctggcatgtgcctataatcccagtgttttgggaggcctaggcgggaggatgccttgagcccaggagattgaagctgcagtgaattatgagccaatgcactccagcctgggtgagagtgagaccctatctcaaaacagcaacaacaacaagatacaaattgagaaactgttacttgatttgcgatatgtattctgtccagcagtgatagaataacaaggactgggtttaccttgctattttaagcaacaatatatgaaatagcaatttgtaggcattgggtaacaggcaaagcaagactgtggtcactgaaagctgggaaacaaacctactgagctctatggttgccccaatttattatctggaggtagttttcaggctgcagagcagggatggggaagtcaaacagagcatggtgtcttagaattgggaggacaagatgggggttggcggggagggaaggttgtcatcattcgtggggcagagtaccagagaggtgggagttgtacacagaactccagtgataggtggaggagtctcctgaaatctggttgagtcctgatctacaggtgcatgagaggagaacacctgaggccagagaaagaaccccactggaaagcagcaggccaaacaattcctgggactcaacacagagctgggaatagtctgtgttcccattagccagagtatatacaagggcatcaaaagggcattgtaaagaggctaaattcgccctaatttaaaggctactctggatctactctaacaatgaaaaagcaagtcttggaagatacagccgatttaaagaatcttacctgtgtgtgagaacaaagtccagccctat

SEQ ID NO: 8809 - DNA, 1545 bp, Homo sapiens
catggtggctcacgcctgtaatcccagcactttgggaggctgaggctggtggatcacttaaggccaggagttcgagaccagcctggccaacgaggtgaaaccccatctctactaaaaatacaaatattagaactgggtgttgtggcacatgcctgtagtcccagctactcgggaggctaaggcatgagaatcgcttgaaccccagaggcagaggttgccgtgagccaagattgcgccattgaactcctgcctgggtgacagagcaagactctgctaaaaataataataaaaataataataatagaagtacatacataaactttaaaatgtaatagaaattatattttgtattcacccttttcccctctgtgaatgaagaagtccaaggccagtcacgtagtacttctgcaaaagaggttatgaatgaatttgtgggacttgttgaaatttcacaggtgagatcctacacagatggagaagaaaatgaggcaagaataggattttggaaacttgcctagaactttcaagattcaagaatcagaaatgataatcaaagagataggagaattaagagtttagtgtcaaactaagaagagtgaattcgaattccaagaaaaaaaggaggaaaaattttgttcggtgttataaagaggtagagctggatgaagactaagcatttaaatactaagttgagggcatagtagctggcatgtgcctataatcccagtgttttgggaggcctaggcgggaggatgccttgagcccaggagattgaagctgcagtgaattatgagccaatgcactccagcctgggtgagagtgagaccctatctcaaaacagcaacaacaacaagatacaaattgagaaactgttacttgatttgcgatatgtattctgtccagcagtgatagaataacaaggactgggtttaccttgctattttaagcaacaatatatgaaatagcaatttgtaggcattgggtaacaggcaaagcaagactgtggtcactgaaagctgggaaacaaacctactgagctctatggttgccccaatttattatctggaggtagttttcaggctgcagagcagggatggggaagtcaaacagagcatggtgtcttagaattgggaggacaagatgggggttggcggggagggaaggttgtcatcattcgtggggcagagtaccagagaggtgggagttgtacacagaactccagtgataggtggaggagtctcctgaaatctggttgagtcctgatctacaggtgcatgagaggagaacacctgaggccagagaaagaaccccactggaaagcagcaggccaaacaattcctgggactcaacacagagctgggaatagtctgtgttcccattagccagagtatatacaagggcatcaaaagggcattgtaaagaggctaaattcgccctaatttaaaggctactctggatctactctaacaatgaaaaagcaagtcttggaagatacagccgatttaaagaatcttacctgtgtgtgagaacaaagtccagccctat

SEQ ID NO: 8810 - DNA, 143 bp, Homo sapiens
gtgaggagctagaactgagctctgagccctcctctgaggttggggcttctgggcaggcagcccccttagaggccctcccttgtaggtattcggccttggttccgtggcccatatgcttctaaataaaacatttgggagctacc

SEQ ID NO: 8811 - DNA, 317 bp, Homo sapiens
cttatgtctgacagaaatgatacttagagtcacctctagagactgtttcaaagaatgaaagcaatggttaaagatggcaatagtcagccaggcacagtggctcacacctgtattcccagcacttttggaggccaagacgggtgactaaaaaaatacaaaattagccaggcatcatggctggtgcctgtaatcccagctgcttgggaggctgaagtaggagaatagcttgaactcgggaggtggaggttgcagtgagctgagatcacaccattgcactccagtctgggttacaagagcaaaactccgtctcaaaaaaa

SEQ ID NO: 8812 - DNA, 842 bp, Homo sapiens
gagtttgaggccagctggcaaacatggtgaaactccatctctactaaaactataaaaattaggctgggattacaggcatgagccaccgtgccctgccctttattactatttttttagagacagggtctcactctgttgcccaagctggagtgcagtggcacgattcatagttcactgcatcctcgacttcctgggctcaagcaatcctcctgcctccttccccagtagctgggactacaggtgtacaccaccatgcccagataatttttttgtttattttttgtagagatggggtctcgccatgttgcccaggctggcattagccatattttaagtgctcattggccacatgtgatgtgacagcacagatatagaatatttccatcatcacagaaagttctggaaatagtgctcttctgtagtaagttttctataggggagattgtattttgactcttgagtattcttgaaataagggaacatttggatgctgctttctataaattcatctcatacttaaactgatacctcattggtcttcccacctgatgagcttcttgaatgaagtgggcacatcacattcactgtatgcctggcatctagcatagagttgatagtggcagatgcttatcagtttcttgtggagttgctgctatttctataacttattactcattgcacttgcttggtctttttcttagtcgtgtagacagtaatttcttttttcagcttctatcagtatagctcattttttctcttcaatctgcttagacaaaatgaggttttcgttggtgtttaatttaaaaattaaaaaaaaattcaggccaaaaggtcttaaaaaa

SEQ ID NO: 8813 - DNA, 743 bp, Homo sapiens
aattcttctgcctcagcctcccaagtagctgagactacaggcgcgcaccactacgcccggctaatttttatatttttaatagagacgggtttcaccatgttggccaggatggtctcgatctcttgacctcgtgatccacctgccttggcctcccaaagtgctgggattacaggcttgagccaccgcacctggcagaggcgggtaaattttgattttactttttcacatagcaggggctgccatctcttatcccccaaccccatgacaggcagctgtggggactgcagttccccattcctggtgcagcttgctggacctggggtgagcaataaggaccttgtcttccaaaagtcagagttgtggggttctgattattgattgttgtttttgattgctgagaggccagcacagaagttggccattgtttatatatccacaggctgaagcaacttaccaaacatgaggggatttaaagaaacaggacctaggtactttttccctcttgagaaccagacatttaaagaaatctctcatcaggtcactggctgaccccagagacaatggaagaaaaatttcagtgaaaacacacaaggaatacttgctttacaaaaatagcttagaaaagtcacaaaaggatggttccagccatcaacaagcaaaacccagcaattcctgaggagtgagagaattaagactgcagaactaccacaacataaggctcagaatgtccagttcacagtaaa

SEQ ID NO: 8814 - DNA, 378 bp, Homo sapiens
agcaatagcgagagacagggagggacctgagagtggaagcctttattgggatgtaaggtggtacctgagcaggtttcctgtggggaggtctaatttggtttaacacaagcagccatgagtctctactgtgactgagaggtggtcactgatatatccacgtggtccctgcagagtatgggggcctatggggggagtcaagtaggttatatctagctgtcccataataaagtggtcaccaggggaaggttgtataaggcagatatcgggatcagtcacatggagaaactgggagatgaactggaaactgctgagggtgactgaaccctgcttctgatatcagaaagtccaatttatatttaaaagggatgctgaggcaac

SEQ ID NO: 8815 - DNA, 495 bp, Homo sapiens
caggatgtctcatgaccgtgccaccttctgcctagccccattctctggaggagctgtgggcagaccgaccccagcctggccgcctggcatggggactggttgcgtcagatcggagctctgagataagggtgggccagggcatgatcatcaccactgccagcctcgaagcctctttgctgacctggaggtgatctgtgtatcaaagggggctgtgtattcaacagcacttccagaagaggccaaagatctgtctctacttcagcctccactgggcagaaaactaagcctatttgctctaggcccttcagacttgcacttggagaaagaaaactcactaagtcagcccttatgtaactccactctcctctcttccaaacctccttgctttggacaaatatttgacagaaaatgcccttttgcaacgccttaaaagttacaaaaatggtgcaccctatcctttaatctgtactgtaaataaaaaatattaacacaaac

SEQ ID NO: 8816 - DNA, 613 bp, Homo sapiens
ttttaaaagtctaatttgagattccttattaaaagatccagaaaagccaacttaaagagaccctgtgtggtaaaacactattcctgctgcacttgtgtaaatattaggccaactttaaagacactaaatttattttgcaaacagattactcttactaatactttgatgatgtttgataaaaagggagtaagtatagagaaaaaactttcagagaaaaaaatatagtgcacctgttattagactctagctcattgtttttgaggttttttcgtctacctgaaatctagactggatcttgaattttttgtttcctgtaatatctggcaatgggctgggtgtcagagctcgcaactgcaatcccagcgctttgggaggtcgaggtgggaggattgctgaagcccaagacttcgagaccagcctgggcaaaaggcgaaacaccgtctctacaaaaagttcaaaaatttgctgggcatggaggcatgcgcctgtggttgcagctgcttggaaggtggaggtggaaggattgcttgagccaaggaggttgaggctgcagtaagccttgtttgtgccactgcactccagcctcaattacaaagcaaggaccccatctcaa

SEQ ID NO: 8817 - DNA, 712 bp, Homo sapiens
tggcgagctccaactgcgggagcatggccttcaaggattctcaactcagggctttctgagctcaggggagatggggtatcagctggaagttcttccctctggaggtgggtttttgggttggtacccccagctactccactgaagagtgggtttcaaatttgtcaccttctctcacgttcatcctccagcctcatccatgcagcgagcaacacacaagctaagagggagtttcaatctacttaatgtccccactgaggtgggtggaaaagggcttagactttggagctgggtagatctgggcttaaatcctggctctagcacaactggctgcatgactctgagcaggttattcaaccactctgacccttggtatcctcctctgtgagacaaatgatccacctcaccagtcaggattgcttaaaaacacctgcacttctgagaagatagctagcccctcctatcagtcaaactagccttgttatttctcccctagcccaatctctatctccacacatgcttacttttgtctctgtatatagcctcacttgttaaaatccacttgacatgtctgtaaggcagatgttcatggtgctttaccaactatcatgatgggataagattcaggacagggagaggtaaaacaagtcatgcagtgaattcctaggtcaccttgttacttttaaaagaccctaagagggctgggcgtggtggt

SEQ ID NO: 8818 - DNA, 263 bp, Homo sapiens
agaccaacaccacccacctggatttgatatgagcgagacgtcaacttccattttgttttatctattgcaatttgggttttctgccatttccagctgaacttaattctaatttaccaattttattaaagctgtttcagagaaaagaacaatagagaaagctgtacaactcctcttatgagagaaaaaatggaatagatgctattcagagacagttataggccattttcccatgtgtagcttgatgtaaattctaaaaaatgaaa

SEQ ID NO: 8819 - DNA, 441 bp, Homo sapiens
ttcatttcttttttccaaaaaaaatttttttttttcagagacaggatctcactatgttgcccaggctgcccttgaattcttaggcctaagggatcctcctacctcagcctcccaaagttctgagattacaggcataagccaccacacccggcccgatctttatttcttttgataggcctctgatgtttcagggtgagctctagggtcagaaatacctgggttcgtgtcccagttctgctgcctagaagctctgtgtgacctcgggtgcattatgtcatctctctgtacctcattttgctcatttgtaaaatggggctcacagttgccatgaagtgccaaggagctgatgtccataaagtcctgggcagagcatcacagtcaatccacgtagccgttgcatttgtcagatggtcctagttaatattaccctctaaaggctgt

SEQ ID NO: 8820 - DNA, 931 bp, Homo sapiens
tctggacatcttgggctctgtctcatattctctaggctcctttttcactctagcccttggtatggctaccaatgcctgagaatgtagcctgacagcacctctgttcagctccaccataaatctcttgatttctgcctcttagcacttctccaccactgcctccctaatacctgccgaaacttgttcagctattctggtctccaggcaaacctggaagtaagatggagttaatatcccatgaagcattcaccaatggggaacagaatttgcttgataactattctccccttgaagcccttgagtgaataactctcaggtgaattatcattggctcctcagatgttcccacgtggattgagtttcagctgcctacagcagtaaaaactttcaataacacacccttggattatttttcctctcttccctattcgttactttcattctttgtgatcgttttccagaataaactatctgtatgcaagttgttgtgttagatttgacatattgaggcgacttagactaaaacaatttacacttatgagagacattacccacttaagaatttcagaaattagtgaacaggtgtagaaattttcactgcaaatttagttgcttaacttacctgtttataaggccaattcaactacacagtcaacatttatggatacagtattaagaagaagtcagtattgacctctttccttagctatgttctatcatagacaataaccagatgatataaatgcaactatgagcaatggagtactttctcttggcagaatctaaaaacacacgacacaatctcccttggaaataacttgtagcacaggaaggaaagtgcatgaaagagccaagaaataaagttgatttgaggttgaaaagaaacatctcttcagggagccacatactcccagaatttttaaaagcaaaa

SEQ ID NO: 8821 - DNA, 587 bp, Homo sapiens
atatatagagtatgttagattgttatgatgacaggaatagtgctagaggcatttagtactcagggtctagggatgctaggtgtcctgagacgtaagagccagccccatattatttgtcctgccccaaatgctagtaacttccctactcacaaagaaatactgatacaggaaagagtgaattctttaataaatcatgttggggaaaaatggttatccatacagaaaaaataaaattagattcctacctcacaccaaacacaaaactcaattctaggtatattaaatacttttagaagaaaacatagttcagtggttctcaacttgcagtaccaccatctacagaacatttgaaaatatatagagtatgttagattgttatgatgacaggaatagtgctagaggcatttagtactcagggtctagggatgctaggtgtcctgagacgtaagagccagccccatattatttgtcctgccccaaatgctagtaacttccctactcacaaagaaatactgatacaggataatttctctagtcttgggataggggataatttctgtaaaaaaaaaacataaagtaccgactat

SEQ ID NO: 8822 - DNA, 344 bp, Homo sapiens
ctatagtatttataacagtgtaatattggtgcacaggttgacaaataggctaatggaacagaacagaaaacctgaaaatagacctatacctatttggaaatttgatatctgacaggtagcattgcagatcggtcaaggaaagagtgaattctttaataaatcatgttggggaaaaatggttatccatacagaaaaaataaaattagattcctacctcacaccaaacacaaaactcaattctaggtatattaaatacttttagaagaaaacatagttcagtggttctcaacttgcagtaccaccatctacagaacatttgaaaatatatagagtatgttagattg

SEQ ID NO: 8823 - DNA, 1720 bp, Homo sapiens
ctctgctcagaaggtccagcatcctgaccagactcggcagcttattgaatttgccggggtgcaagcttccttgcactgtccacatgttcttaccagggaagggtctacccagggccatcctgcctcaaaggagaagtggtttactgttttctccacctttagagggaatgagggtccctgctcctggtccttactctactccactgtccaattggcgcatgccctgaggctctcattatacaaattggaagctaaggtgcaaaagaactaagaatttgcataaggtccccaacaggtgaaggcaggccccaaacctaggatctagatttcgtttttctgaccccgcttcctttaacctgcagggctggcccaacgccccgggcttcacccaacactgggcgcaggcgggaaggccgagaggctgggtcgggcgcccaagcgagggcccaggtggggcgaaacaggcgcagtcaaggggctggcaccttggccccccgccgtggattcaaagggtcaggctccgccccctccaagccccgagcccactttgatgtgctgatgcggcctggaaggggccacttcacacctcgggctcggcataaagcggccgccggccgccggcccccagacgcgccgccgctgccatggcccagcccctgtgcccgccgctctccgagtcctggatgctctctgcggcctggggcccaactcggcggccgccgccctccgacaaggactgcggccgctccctcgtctcgtccccagactcatggggcagcaccccagccgacagccccgtgccgagccccgcgcggccaggcaccctccgggacccccgcgccccctccgtaggtaggcgcggcgcgcgcagcagccgcctgggcagcgggcagaggcagagcgccagtgagcgggagaaactgcgcatgcgcacgctggcccgcgccctgcacgagctgcgccgctttctaccgccgtccgtggcgcccgcgggccagagcctgaccaagatcgagacgctgcgcctggctatccgctatatcggccacctgtcggccgtgctaggcctcagcgaggagagtctccagcgccggtgccggcagcgcggtgacgcggggtcccctcggggctgcccgctgtgccccgacgactgccccgcgcagatgcagacacggacgcaggctgaggggcaggggcaggggcgcgggctgggcctggtatccgccgtccgcgccggggcgtcctggggatccccgcctgcctgccccggagcccgagctgcacccgagccgcgcgacccgcctgcgctgttggccgaggcggcgtgcccggaagggcaggcgatggagccaagcccaccgtccccgctccttccgggcgacgtgctggctctgttggagacctggatgcccctctcgcctctggagtggctgcctgaggagcccaagtgacaagggacaactgacgccgtctctgtgagcaccgaggctttttggcctcagcaccttcgaagtggttccttggcagactgcctttcctggaagagggcacgggcgatcccgacgggggcattcctgcgggtgagagccgtccccaccgcggcggcccttctcagcccctccctccatggagggacccatagggctagacactttgaggcaagcaggaggctctgcctaatgtgaatttatttatttgtgaataaactgtactggtgtca

SEQ ID NO: 8824 - DNA, 1205 bp, Homo sapiens
ctctgctcagaaggtccagcatcctgaccagactcggcagcttattgaatttgccggggtgcaagcttccttgcactgtccacatgttcttaccagggaagggtctacccagggccatcctgcctcaaaggagaagtggtttactgttttctccacctttagagggaatgagggtccctgctcctggtccttactctactccactgtccaattggcgcatgccctgaggctctcattatacaaattggaagctaaggtgcaaaagaactaagaatttgcataaggtccccaacaggtgaaggcaggccccaaacctaggatctagatttcgtttttctgaccccgcttcctttaacctgcagggctggcccaacgccccgggcttcacccaacactgggcgcaggcgggaaggccgagaggctgggtcgggcgcccaagcgagggcccaggtggggcgaaacaggcgcagtcaaggggctggcaccttggccccccgccgtggattcaaagggtcaggctccgccccctccaagccccgagcccactttgatgtgctgatgcggcctggaaggggccacttcacacctcgggctcggcataaagcggccgccggccgccggcccccagacgcgccgccgctgccatggcccagcccctgtgcccgccgctctccgagtcctggatgctctctgcggcctggggcccaactcggcggccgccgccctccgacaaggactgcggccgctccctcgtctcgtccccagactcatggggcagcaccccagccgacagccccgtgccgagccccgcgcggccaggcaccctccgggacccccgcgccccctccgtagctccttccgggcgacgtgctggctctgttggagacctggatgcccctctcgcctctggagtggctgcctgaggagcccaagtgacaagggacaactgacgccgtctctgtgagcaccgaggctttttggcctcagcaccttcgaagtggttccttggcagactgcctttcctggaagagggcacgggcgatcccgacgggggcattcctgcgggtgagagccgtccccaccgcggcggcccttctcagcccctccctccatggagggacccatagggctagacactttgaggcaagcaggaggctctgcctaatgtgaatttatttatttgtgaataaactgtactggtgtca

SEQ ID NO: 8825 - DNA, 2944 bp, Homo sapiens
  misc_feature (1892)..(1892): n is a, c, g, or t
  misc_feature (2215)..(2215): n is a, c, g, or t
  misc_feature (2272)..(2272): n is a, c, g, or t
ctctgctcagaaggtccagcatcctgaccagactcggcagcttattgaatttgccggggtgcaagcttccttgcactgtccacatgttcttaccagggaagggtctacccagggccatcctgcctcaaaggagaagtggtttactgttttctccacctttagagggaatgagggtccctgctcctggtccttactctactccactgtccaattggcgcatgccctgaggctctcattatacaaattggaagctaaggtgcaaaagaactaagaatttgcataaggtccccaacaggtgaaggcaggccccaaacctaggatctagatttcgtttttctgaccccgcttcctttaacctgcagggctggcccaacgccccgggcttcacccaacactgggcgcaggcgggaaggccgagaggctgggtcgggcgcccaagcgagggcccaggtggggcgaaacaggcgcagtcaaggggctggcaccttggccccccgccgtggattcaaagggtcaggctccgccccctccaagccccgagcccactttgatgtgctgatgcggcctggaaggggccacttcacacctcgggctcggcataaagcggccgccggccgccggcccccagacgcgccgccgctgccatggcccagcccctgtgcccgccgctctccgagtcctggatgctctctgcggcctggggcccaactcggcggccgccgccctccgacaaggactgcggccgctccctcgtctcgtccccagactcatggggcagcaccccagccgacagccccgtgccgagccccgcgcggccaggcaccctccgggacccccgcgccccctccgtaggtaggcgcggcgcgcgcagcagccgcctgggcagcgggcagaggcagagcgccagtgagcgggagaaactgcgcatgcgcacgctggcccgcgccctgcacgagctgcgccgctttctaccgccgtccgtggcgcccgcgggccagagcctgaccaagatcgagacgctgcgcctggctatccgctatatcggccacctgtcggccgtgctaggcctcagcgaggagagtctccagcgccggtgccggcagcgcggtgacgcggggtcccctcggggctgcccgctgtgccccgacgactgccccgcgcagatgcagacacggacgcaggctgaggggcaggggcaggggcgcgggctgggcctggtatccgccgtccgcgccggggcgtcctggggatccccgcctgcctgccccggagcccgagctgcacccgagccgcgcgacccgcctgcgctgttggccgaggcggcgtgcccggaagggcaggcgatggagccaagcccaccgtccccgctccttccgggcgacgtgctggctctgttggagacctggatgcccctctcgcctctggagtggctgcctgaggagcccaagtgacaagggacaactgacgccgtctctgtgagcaccgaggctttttggcctcagcaccttcgaagtggttccttggcagactgcctttcctggaagagggcacgggcgatcccgacgggggcattcctgcgggtgagagccgtccccaccgcggcggcccttctcagcccctccctccatggagggacccatagggctagacactttgaggcaagcaggaggctctgcctaatgtgaatttatttatttgtgaataaactgtactggtgtcagttggcaatttcttcttcctacccgtggacacagagctccctctctccctccaaagaagagcatgggagaggtgggaggggttcttgcaatctttagccccccgacccccacaggcccagacccctttggccttacccccagccctggctcagcatctagtccagatgggtnagcctggaatgggtggggagggacgtcctgtgagaaggcagcggcaagtagaatctgctcatcttttctttgaacctggtggggaactggttaaaaccaaaatatctgtgtagaaatacaactccattattgagtatttattgtatgtacatcaggtacctattatactcaagtaaccattttacagaaggatgaggatcagcgctcaagcccaggtaggcctccagagtcccagcgctcagctcttgtgggattttgccagctccatacatgttggggcctgagggataacagctccaaggggttattttcttgcatcctgnggtcttattctccatgcacgggagcatcctggccttggaactcccccaccctccgcnggcattttcccatctgccttttctctggtttccccaccttgtggcttagagacataaataatggtgtggcggtcctgagtttatataaccatgacctcctacaggcctagatggggtgagatgaggggcccatggggttgcatcggaatccacacaggcagttgcgtgcctgtctgcattggctggattcacatcagggagcaagaaacgggaggcttgagcccagaaagtgtgtcctcatccagccagggtgtctgggcaacagtcatgattagagggtgcggtggggagaagggatgtgtagcctctctgccaagcgtcctttaccctctatggatagatacccagttctcccctcctctccttcaagtgtctgaaacacaggcttcagtgtctgtttttataagagctttattaggatacaattcacataccataaaattcactcttttaacaactgaatggctttagtacatccacagagttgtgcaagcattgccactaattttagaacgttttcaccccccaaaagaaaccgtatacctgttaacatcactcctcactattccctactcccagtccctggcactcactcttctagtctctgtctctataggtttgctttttcaggacatttcatataaaaggaatcgcaaaatacggccttttgtg

SEQ ID NO: 8826 - DNA, 2429 bp, Homo sapiens
  misc_feature (1377)..(1377): n is a, c, g, or t
  misc_feature (1700)..(1700): n is a, c, g, or t
  misc_feature (1757)..(1757): n is a, c, g, or t
ctctgctcagaaggtccagcatcctgaccagactcggcagcttattgaatttgccggggtgcaagcttccttgcactgtccacatgttcttaccagggaagggtctacccagggccatcctgcctcaaaggagaagtggtttactgttttctccacctttagagggaatgagggtccctgctcctggtccttactctactccactgtccaattggcgcatgccctgaggctctcattatacaaattggaagctaaggtgcaaaagaactaagaatttgcataaggtccccaacaggtgaaggcaggccccaaacctaggatctagatttcgtttttctgaccccgcttcctttaacctgcagggctggcccaacgccccgggcttcacccaacactgggcgcaggcgggaaggccgagaggctgggtcgggcgcccaagcgagggcccaggtggggcgaaacaggcgcagtcaaggggctggcaccttggccccccgccgtggattcaaagggtcaggctccgccccctccaagccccgagcccactttgatgtgctgatgcggcctggaaggggccacttcacacctcgggctcggcataaagcggccgccggccgccggcccccagacgcgccgccgctgccatggcccagcccctgtgcccgccgctctccgagtcctggatgctctctgcggcctggggcccaactcggcggccgccgccctccgacaaggactgcggccgctccctcgtctcgtccccagactcatggggcagcaccccagccgacagccccgtgccgagccccgcgcggccaggcaccctccgggacccccgcgccccctccgtagctccttccgggcgacgtgctggctctgttggagacctggatgcccctctcgcctctggagtggctgcctgaggagcccaagtgacaagggacaactgacgccgtctctgtgagcaccgaggctttttggcctcagcaccttcgaagtggttccttggcagactgcctttcctggaagagggcacgggcgatcccgacgggggcattcctgcgggtgagagccgtccccaccgcggcggcccttctcagcccctccctccatggagggacccatagggctagacactttgaggcaagcaggaggctctgcctaatgtgaatttatttatttgtgaataaactgtactggtgtcagttggcaatttcttcttcctacccgtggacacagagctccctctctccctccaaagaagagcatgggagaggtgggaggggttcttgcaatctttagccccccgacccccacaggcccagacccctttggccttacccccagccctggctcagcatctagtccagatgggtnagcctggaatgggtggggagggacgtcctgtgagaaggcagcggcaagtagaatctgctcatcttttctttgaacctggtggggaactggttaaaaccaaaatatctgtgtagaaatacaactccattattgagtatttattgtatgtacatcaggtacctattatactcaagtaaccattttacagaaggatgaggatcagcgctcaagcccaggtaggcctccagagtcccagcgctcagctcttgtgggattttgccagctccatacatgttggggcctgagggataacagctccaaggggttattttcttgcatcctgnggtcttattctccatgcacgggagcatcctggccttggaactcccccaccctccgcnggcattttcccatctgccttttctctggtttccccaccttgtggcttagagacataaataatggtgtggcggtcctgagtttatataaccatgacctcctacaggcctagatggggtgagatgaggggcccatggggttgcatcggaatccacacaggcagttgcgtgcctgtctgcattggctggattcacatcagggagcaagaaacgggaggcttgagcccagaaagtgtgtcctcatccagccagggtgtctgggcaacagtcatgattagagggtgcggtggggagaagggatgtgtagcctctctgccaagcgtcctttaccctctatggatagatacccagttctcccctcctctccttcaagtgtctgaaacacaggcttcagtgtctgtttttataagagctttattaggatacaattcacataccataaaattcactcttttaacaactgaatggctttagtacatccacagagttgtgcaagcattgccactaattttagaacgttttcaccccccaaaagaaaccgtatacctgttaacatcactcctcactattccctactcccagtccctggcactcactcttctagtctctgtctctataggtttgctttttcaggacatttcatataaaaggaatcgcaaaatacggccttttgtg

SEQ ID NO: 8827 - DNA, 2106 bp, Homo sapiens
ctctgctcagaaggtccagcatcctgaccagactcggcagcttattgaatttgccggggtgcaagcttccttgcactgtccacatgttcttaccagggaagggtctacccagggccatcctgcctcaaaggagaagtggtttactgttttctccacctttagagggaatgagggtccctgctcctggtccttactctactccactgtccaattggcgcatgccctgaggctctcattatacaaattggaagctaaggtgcaaaagaactaagaatttgcataaggtccccaacaggtgaaggcaggccccaaacctaggatctagatttcgtttttctgaccccgcttcctttaacctgcagggctggcccaacgccccgggcttcacccaacactgggcgcaggcgggaaggccgagaggctgggtcgggcgcccaagcgagggcccaggtggggcgaaacaggcgcagtcaaggggctggcaccttggccccccgccgtggattcaaagggtcaggctccgccccctccaagccccgagcccactttgatgtgctgatgcggcctggaaggggccacttcacacctcgggctcggcataaagcggccgccggccgccggcccccagacgcgccgccgctgccatggcccagcccctgtgcccgccgctctccgagtcctggatgctctctgcggcctggggcccaactcggcggccgccgccctccgacaaggactgcggccgctccctcgtctcgtccccagactcatggggcagcaccccagccgacagccccgtgccgagccccgcgcggccaggcaccctccgggacccccgcgccccctccgtaggtaggcgcggcgcgcgcagcagccgcctgggcagcgggcagaggcagagcgccagtgagcgggagaaactgcgcatgcgcacgctggcccgcgccctgcacgagctgcgccgctttctaccgccgtccgtggcgcccgcgggccagagcctgaccaagatcgagacgctgcgcctggctatccgctatatcggccacctgtcggccgtgctaggcctcagcgaggagagtctccagcgccggtgccggcagcgcggtgacgcggggtcccctcggggctgcccgctgtgccccgacgactgccccgcgcagatgcagacacggacgcaggctgaggggcaggggcaggggcgcgggctgggcctggtatccgccgtccgcgccggggcgtcctggggatccccgcctgcctgccccggagcccgagctgcacccgagccgcgcgacccgcctgcgctgttggccgaggcggcgtgcccggaagggcaggcgatggagccaagcccaccgtccccgctccttccgggcgacgtgctggctctgttggagacctggatgcccctctcgcctctggagtggctgcctgaggagcccaagtgacaagggacaactgacgccgtctctgtgagcaccgaggctttttggcctcagcaccttcgaagtggttccttggcagactgcctttcctggaagagggcacgggcgatcccgacgggggcattcctgcgggtgagagccgtccccaccgcggcggcccttctcagcccctccctccatggagggacccatagggctagacactttgaggcaagcaggaggctctgcctaatgtgaatttatttatttgtgaataaactgtactggtgtcaaaaaaaagtaaaaaaaaaaaaaaaaaaaaaaaaaaaaaaatttgttggggggcttgggccctggaaaggtttttaaaaccattgggtgggggggggggccccatgatgggtaacggtcgaccctgtgggccaaaagcgctggtccccaaggagaggactcgtggcgcctggcgacgagagggcctggggggtttccctccacaattataaaaaaaaaccgcgccgggggcgggacagccccgaggcgcctgtctcaggagaacaaactcccccaagagggagagtccagggagggcccataacacgggggtcctcaatcaacagggggggctctccaacggggggacgccagattttctaaaattaacgccgaccgcgtgggggcg

SEQ ID NO: 8828 - DNA, 658 bp, Homo sapiens
tgaatttttttaagaaaactcatcaaatttcagggtatcacaaaactttattatattattatactgcccactatttattatatgttatagatgtctgagaggtaaaccaaatattttatttttaatgttaaaaaaacatcaaatttaactttattagcatattttagcaactttgggataaatacggacttttacttgattttgaaataatcccagtgtaggcccatgtgctggatctgttggatgctagaatatgggctttgaacctaatacaaatatattactagaaaatgtgatttttttaaatgccaagtaaattgatattagtgtatgaattagtcatattttaaaacattatgtggttagagaaatgcggttttctgccatgaatgttaagttgcaaatcagtggaaatggagtcgacctcttcggagcacagggtgtcattgccctcgttgttcaagaggccagaatttttctatccccgctaagaaacaaagcatctatgttgagatatgtgtttttttgtttgattaatttgagatcattctaaatactttatacaatattttcacatgcacaaaaatgcgcgttagtggtttttggagaggggtgaggggtgggggaagtgcaaaataaagattattggctatttcat

SEQ ID NO: 8829 - DNA, 330 bp, Homo sapiens
taaattcgcggccgcgtcgacaatatatttaggttagcaaaactgtacatatactccctgaatcttaaataaaagttggaaaagcaaaagaattctgtcaagatatttgttttccctttagtaccttaaaaatgtagttcatatcttcaggctgtattatttcttatgaaatgtctgaattgtttttattgttcctttgtatgtaatgtttgttttgacactaatttaaaattttaaaatttgtctttggttacagaaactgactgtgatatgcctatgactgatattctttgtactaataaattaacatgttttatcaaatttaaaaaa

SEQ ID NO: 8830 - DNA, 352 bp, Homo sapiens
gctgccgcctactactactaaattcgcggccgcgtcgactactccctgaatcttaaataaaagttggaaaagcaaaagaattctgtcaagatatttgttttccctttagtaccttaaaaatgtagttcatatcttcaggctgtattatttcttatgaaatgtctgaattgtttttattgttcctttgtatgtaatgtttgttttgacactaatttaaaattttaaaatttgtctttggttacagaaactgactgtgatatgcctatgactgatattctttgtactaataaattaacatgttttatcaaatttaaaaaaaaagtcgacacgcaaacgaatttagtagtagtag

SEQ ID NO: 8831 - DNA, 335 bp, Homo sapiens
accaaaacccagcgacgagacatccccaagtcccaccttaatgggacttttggtagcctttggaacagggaaaacccaaaaatagccaagaggtattcaccagaaagcctgaaagtgggagtggttttgctcgttcctatagtagtgagggcaagtggcgtcgaggaggtctgaaaggtgtagagttctctgggccctgtgaactctgccactaaccagccacgctgatggccagctttcaggatagctgtggagaagctgctgggagtagaggcacattgaaaaggttagggatggccaggcatggtggctcacgcctataatcccagtacttt

SEQ ID NO: 8832 - DNA, 496 bp, Homo sapiens
ctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatg

SEQ ID NO: 8833 - DNA, 841 bp, Homo sapiens
tatgattaaaaattaaaactcttttattcaatcttttttttcccttgtctataaggcagaaaaaaagggtgacaaggaataggcaaagcatgttatttccttaacttacataattacaatccagtaccactctaccctgcacgctacttttctacactatgcttcctccttctcattcttattcagggagaaaaatgtcaaataattttagaacagattttaaggttaaactgtattaacttctaagagaccttcattttacttacagatagtcatgtacacaagcaaccaatacatttatttaaagttatggctagaattaacagctcttatgaatacaatgtgcccacaaaaactcactattgaaggttttaaaaccaaaaaacttcataccaccacatttttacacacattaaataagaaaatataacctggaaagaaaacaagttttaaaatagtattttagggccatttcattcacccaaacatttgctgaatttctattgtgtatccagaattgttctaagggggtgtgtgtgtttatgctagaagaacacagcagtaaacaagacaagagtccttgccctcatagagcttacattctaatagggaaaagaccattagcaaatacataatataatttcagatatatgctaagaagaaattaaaagcagcatacaggataggcagtgatttgggagagaaagaccatagtttagataaaatggtgaggaaaatcttccctgagaagataacttttgagcagcactgaatgataagaagggataagcagttcaccctctttataatccaattctaaaaggccatgaggaatgagctt

SEQ ID NO: 8834 - DNA, 581 bp, Homo sapiens
tgcgagtagcaaaccacaagacctgggaatcattggggttttttctctttctcttatactcggcacatagaatctggccaagaaaacccaattgggctctatttttcaaagtagatcccagattattctttctacaaggtctaccgctatcaccctagtgcaggccaccatcattatccaccttaatgatgggaatagtatcctaacttccccctacttgggtgccttacaatctatggtccacagagaatccagagtgattaaggtggggtgtgtgtgtttatgctagaagaacacagcagtaaacaagacaagagtccttgccctcatagagcttacattctaatagggaaaagaccattagcaaatacataatataatttcagatatatgctaagaagaaattaaaagcagcatacaggataggcagtgatttgggagagaaagaccatagtttagataaaatggtgaggaaaatcttccctgagaagataacttttgagcagcactgaatgataagaagggataagcagttcaccctctttataatccaattctaaaaggccatgaggaatgagctt

SEQ ID NO: 8835 - DNA, 637 bp, Homo sapiens
ctgattcttaaaatgaggtgatctgaactttttaggacatcctaatgcccatgcagtctgaatctttcttcaaaatacccactcagacgctaaaagcaggggagcttgagatccagggtgatgtttgaattgaggctttcaaaggaagaggaagataacctttgaagaaggtaaccaagcaggagggagaaggccctacatggcaatggtaacatcatctcaaagccaaggaaatgggcatgttgtttatatcgccacaggattttttttgtgtgcaatagtctacctttttctttccaaagtctatcatactatggcaaaagatgtagtcattcaatagagttatgcaattctagctttccatcaattacaaaaaatatgactatctaccttgattaattggattgttatacaaacagccctgcagtagtaaacgtccagtgtgtgggcagtgggggcatatgtttgtcatatccattaggggagcacttggggcccagaggactgatgaattggccccacattgtcttactacacagctgtcatagcttcttctgatagcaggtgatagttcttgcaagagcgtgtcaaattggagcttatctcttatgacatctgttgatggaagctccctttt

SEQ ID NO: 8836 - DNA, 568 bp, Homo sapiens
ctccatcatttttcattttttcatagtctttttttttttttaaggggctcactacattacccagacaggctcaagcaatcctcctacctcagcctcctgagtagctgggactacaggctcacaccaatgcccccaaccattttgtcatagtctacttgttagaaggaagtcactgagtatagccattacccaaggaaagggaaattaggctccatcaaagggaggaatatcttaaaatttgtgggcaaattttaaaaccatcacagctggctctgggagtacttttctgaccaaggtagtatcataacaggttttattcaagtgtatatctggttagtcaagaacttagttctcactcacaaactggttcttagagctgggtaactattgctgtcttattccccccttgaaatatatttaacagttattagggaactggatgaagaggaataatgtgaacatgtacattaatttattcagtaaacattcaccagatgtcactctgcagagatataaaacaaaccacggtctatgtctttgaggaatttgtactagggaaaatagacaa

SEQ ID NO: 8837 - DNA, 484 bp, Homo sapiens
ttttttaatagaacagaaaaggagaggacaatggttttctgtctctactcagtttccaaaaacctctattgactactcttaccacaacacagcacccctccccgcagctgtctgccacttgcttcacttgtggcacctggttccatccaagcaaactcgagtccgcacacctgtgggaaggcaaccggcaggagcaaggcagagccctcgagggaaaggtcctggctgagctgtcttgcaaggccacccacagccgggccagctcccttgtgccaggccacaacagagatcccctgtatgggggagatgggggctcccctgcctgggggaagctggtggtgtccagcctgcccagcaccacagccaggccagcaatcagatgcaggcgggagaagaatgatctattagttgagtggccatagttatttggtgttaggcaacaccccaccctcccccaaaaaggtcttcggacatctggtcttct

SEQ ID NO: 8838 - DNA, 431 bp, Homo sapiens
gacagtctcagcatctggaaggttccagctcccacagctggtgtggaaatctcctcctcaccccacctgggtcccctgcccatttcagccgtcacctagctggataagcctggaccactgagtgctgccctagagggaaagtcggagcccaggaggtcccagtaggcctcgggtagcccctcatgtcgcacgctggcccctgccaggctgcatgcccttggcactgcctcgtcccacatacattccatatggggacctagagccgcaggaaaacacagacccacacaggcccggcttcactgtgaaaaaacaggcatcatagaaaagggtcagaaaacgggttactgcatctttcacatttcatgatactttatcggtttactatcatagtaaacgtaagcttgaaataaaaaggtttcttgtcactaaat

SEQ ID NO: 8839 - DNA, 456 bp, Homo sapiens
ttttttttctgagatggagtctcactctgtcttccaggctggagtgcaatggcgcaatctcagctcgctgcaagctctgcttcccgggttcatgccattctcctgtctcagcctcccgagtagctgggactacaggcgcccgccaccgcacccagctaatttttttgtatttttagtagagacgaggtttcaccatgttagctgggatggtctccatctcctgaccttgtgatctgcctgccttggcctctcaaagtgctggaattacaggcgtgagccacagtgcccggcctataacagtccaatctaatgtgactcctgaatgaaagtaggcccaccctatttgcttaggtgatctgaagaagccattccagagaatctgtgagcctctcttatgcatccaggggtgaaaatggaaacagagtacaaaatctgactatttaactttaccaacca

SEQ ID NO: 8840 - DNA, 543 bp, Homo sapiens
ttcattaaaaatgttccggtcgggtgcggtggctcacgcatgtaatcccagcactttgggaggctgaggcaggcggatcacgaggtcaggagttcaagaccagcctgaccaacatgctgaaaccccatctctactaaaaaatacaaaaattaaccaggtgtgtaatcccagctactcgggatgttgaggcaggagaatcgcttgaacccaggaggcggtgagccgagatcgtgccattgcactccagcctgggcaacagaggaagactatcaaaaaaaaaaaaaaaaaaaaaaagttcctgctgttcaattagttccttttacctgaaactattctcagcctgtcccaagttacttgtgttaaactttggcatcacatcacaaactcaagatccagaaacttgagcactctgcatcataattgtcttgtgcctcctggtggttaaaaaacctgtcgctccgtgaagcctctggaaaggcaagggaatatacttgatggggatagtagttattctctaatcctccattcaaccaaaaaaaaaaa

SEQ ID NO: 8841 - DNA, 483 bp, Homo sapiens
tatttgtcctattgtgcagattcaggaggagcctaaagcggtagcaacaatgagttagactcaaacccgtctcctgactcccagtctaaggctttacagagactctcttcctgacccaagcatggcttccttgggtactgggcaaagtcctaagtgtcctgcaaccaagtaaagaacaaagaactaatcatgactgccccctctccccccagcagcttaacattgaactgtcttccaaggcaaaggtgaggcaggaggcagcccagtgtagtgaggtggtgtgtgtaaagtctccaaatgtacctggctacatagtgcttgctggaagctaggtactctgcacatgccctacatgggttgttttacttaatgcttgtaacagcctcgaagcgtagattatccccagtttacaatgaagagtgcgaagtgtcttgtcgaaattcaaagagaataaactactgacatagatttgaaaatcggctc

SEQ ID NO: 8842 - DNA, 1061 bp, Homo sapiens
atattattgctattattatttaaataattatttgtaaaccacagcttgatttggagttaagtgttgtctgtgtcttcactgtagctggtaatttactatggtattaatttaaagaaataaattcaatacagcatcacgtctgtttgggaacacacattttgctctatgtatattgtaactaaatggttagtaaactttaaggcatgtggtgactaacgtagcccttagataggaggtttgtcatttttaatgtgttgaaaatagtacagacatggtgacagaaagcaggggtaaagttgaacgtctatgagcattgtctgtctgttttcttaactctttacatgatctgtgagcacctgcttcttctcaaagaactcccttagtaatcatttgtgcctaatgcatcccacacatgtggagtatgactggaacacaattgaaagattcctaacaactggctgcggtaaataacccaagttaagagcatgacttaaagtggaggtcttcagtatctctggcactggcaatacatttaagaacatacagagatcacacattatgtgggacagggcctgcagatagacttgaggacagaaaacaaaaacaaaagcagaaactctaaagtggatccttgctgcctgttatgccttttgtggatataatacctataataccaaaatgagttgttatgtttaatttcaaacaaatcccaactggtgtggaagtaattaactgctagtcgatgtaatgtaatcatcaatatgctggtgacatatgatggcatgtcaggaatactgttgtacagaaagggattgttcagtctacctagaacctatgggaaagctgcaagaccatttacatatcagtacaaaactcctttattttattaaaatatgagaattaacttccatttattaagattacgtattgctcctttaaattattaaaggtttacatttgataggattaatggatttggtagtgaaatatttttatatatatacatttttgttttattttgagcactattgggaaacacttccgaggtaccgactcgatct

SEQ ID NO: 8843 - DNA, 466 bp, Homo sapiens
ggcagcatagtgaattcgcatctctacaaaaaatcttaaaaattagcttggggtggtggcacacacctgtagtcctagctacttggaaggctgatgtatgaaaactgcttcagctcaggagtacgacgctgtggtagctatgatcatgccactgcactccagcctgggtgacagagcaagatctagataattacagtctgtcctgctcctgtttatgttaaaatgctttcaatcagcaggataaaaattaagtgaaatgtgacttgggagcttggccagaaaataggcaatggagaaacaggcacttcccacaagaataaaaatggccaataagcacataaaaatgattcaaggccagggccgtggctcacgcctgtaatcccagcactttaggaggccgaggtgggtggatcacctgaggtcaagagtttgagacgggcctgaccaacatggtgaaatcccatct

SEQ ID NO: 8844 - DNA, 388 bp, Homo sapiens
gaagatgagcagaaatcttgagggagaaggtatttctctgtgtaaccaattccaagtgacttctgttgctctgaaaactctatggcccatgattaaaatgaccatgatctaagagtgttgtgtacaattaatagaacaaagccaacctgtggccagttcatttttacttactgaattcttaccagctgttgaggaaaaagaaatgatgcaagactgaggcaatgccagagaacactccttgtatttatcatcagttgtcttcagttggcttttcttagttctgggttgcatctttgcagcctggttccctctgcatgctcattctaccttcctttgtgccctcctaggctgtattaagaagcagtacagggtcacctttagatgaaag

SEQ ID NO: 8845 - DNA, 962 bp, Homo sapiens
cgcacacgacctcagcctcctctgccccgctgggcgcgagctgcagtcctggcaccttctgctggggtcctgatctgagccagttgtctagcgatttaatttggtgaatttaccactgcgtcccagagtttatattggcacttaacagcagtaatatgtttctctctcgccaagaactattttcccgaccaagatggaacaccacgcacaaaaaataggtttgtgaactaatctgctgccctgacaagtgtcattcacagaatcactgctatagagcgcactcggaattaaatgaggctggggttgtctggcctggatcacaggtgctttttcccactcagttaacaggagtctgggatgagacaccctttccctgcagccgcaggcactttcaaatcacactatcagtattcatgacagatttctctcttagaaaaatggtttgaggatggttagaggtctctctctctctctctcttttcccttctaacctccctttcttccctcctgggtggttctttttaggatgcccccaccctgtctgtccttataaaatgcagctctgtaaacatttgtctaatttcacaagctcagggaggtgcccccatcagttaaaaaaaaaaaatctcctagtgcctgatgcctgtttgaaattctaaagtggaacttaattgctttcgcgtaaggatttgattcgggcaaactgcccatacctctgggagtagaagcaggatctgtcatttacactttagtctgaatgggtgcctgaacctgggagaaaacagctttgtctttccctggtctgccttggatgtcagaggcttcttaaagacagcgttattgaggggcatggtggctcatacctgtgatcccaccccttggggaggccaaaatgggaggatcacttgaggccaggagttcgagagcagcctggccaacgtggcaaaaccccatctccttaa

SEQ ID NO: 8846 - DNA, 603 bp, Homo sapiens
tgcatctttttcttttgcaaattaaaaaaaaattctttttcggtttttttctacatttaaattttgtcagatgataggtgataaaaggatatttagatggtttcattagcattctttaatgtattagtgagctagaatgcattttcttgtgattactggccatttgcgtttcttcacctgtgaaccatatacatattttttcagttttgttattttgttataggagctgtacatgtgttaaacctaaaacccttcactgatggatgcatgcattatttcaacacatctttgttgggtgaatattatttatgagacactctagcaaaatccatgtcctagatatctcttctgagatcttggctcttatatttatgggagatgtccccctgcagcaagaaaagtattagtgcccatgtaaacatgcgtggcttgtcaaggatcacatgcacagacagttcacacttactcctaaacccggcatggccacagagtagaaagggtgtgtagtgcgttatatgaggagagcactggctcaggattgtgatttctgtgatctctatattaatggcaatgttttaaaaaattacataacatttctgagtt

SEQ ID NO: 8847 - DNA, 531 bp, Homo sapiens
caagggaggtaactcgtctatcattcactcaaattggtaaaacaatgacaccagtataccgtgtggttaagatatagatgcacagatatacgaatgtctggaaaaaccaagagggctatacaaacagacatactcaaaagcactatggataaggcaaaacaccattctcaaagatgttcaagtcatgacaggaaggtaagaaaaagaaagcatatccagaaaacgaaaccagggagaacaaacagaaaaggaaaaataaaatggcagatttaagccctaccatgtcaatatcattaaatatcaatggcctaagtataccagttgcaagacacaggctggcagagtaggttaatggacacgaaccaactacatactggctacaaagagactaacttcaaatatgatgatacaggcaagttgaaatgaaaagggtgggaaaagatatatcatgcaaaccttagccaaaggaaagcaagactggctatattaatgccagatatagtatatttcagaacaaataaactaatcaga

SEQ ID NO: 8848 - DNA, 408 bp, Homo sapiens
cctgtacagccaccatcctcatttccctgtgagctctctgtccctctcctactctcagcccagtgacctgagtggggctggcccctactccctgatcccatggtgaactggcccaggcctctcctgttagcatattccatcccctgactcagggatgtgttcagtgatgaggatgtgacccaagctagaccaattaagtgtcagcattgggcatttggggccactggaaaacaggtatactctttctttgaagatttctaatctcgtaggatacaaatctagattttctgggaatattttttccctttcttttttgaaacagtctctcaggctggaatgcagtggcacaatcagggctcatggcagcctcaacttccctggctcaggcattcctcctacctcagcctc

SEQ ID NO: 8849 - DNA, 389 bp, Homo sapiens
atgtccagagtaatataatttggcaatgttaatgcttttaagatttgaacttgtcctcaaaccaaggagacaacaatagtgtaatactattggacttacaggattagttttaaagcaactttgaatagaagtgtttcagacataggacttctgccttgttgactagagtggatagttttctgtttaaatgcattggtcttttggctgtttgtaattcacttcagcttatagagaagttgatgaccttggatcatgctgggtatgattggtctttaaaaagcagtaatataccaccagcccaaggagaaaacattgttaaaatgaagagtggtggaaatagtgtgttgggaagaataaaaaatttagattggcacttattctaaagtgag

SEQ ID NO: 8850 - DNA, 650 bp, Homo sapiens
tcttaattgatctaacaaataatttgttcaaattaataaaagcagcaatgtatttggtgattatagcttatggataagtgaaacaaatgacagtaatgtcataagggacaggagggagaaattagaaagaccctcacatgatgcttctactacccatgaagcagtatagtgttatttgaaagttgttagccgggtgcagtggctcctgcctgtaatcctgtactttgggaggacaagacaggaggatcacttgagcccatgagttcaagaccagcctgggcaggatagtgagaccctgtctctacaaaaaatttaaaaattagccaggcatggtggtgcatgtctgtagtcccagctactcgagaggctgaggtgggaggatcccttcagcccaggaggtggaagtggcagtaagccaagattgtgcacccctgcactccagcctaaataagagtaagagcccgtctcaaaaaaataaaaaataaagaaagttgtaaattagttgtaaatgtatgctgcaaaaactaaaagacagtaataaaaacaatataaacatatatatgtataaatgatatgatgagaggaaaaaattatagtcatataaaacacacaattaaaaccagagaaggcaggaaaaaagtggaagacaa

SEQ ID NO: 8851 - DNA, 423 bp, Homo sapiens
ttcatgcttcagtcagcggtacttaattgcatataaggcatctggggagctctttgaaaatgtatatttcgggacaccatatccagagagtttgattcattgagtccagtctgggtcctaggaagaactattatcaacatcccatttaaatctagtgcaggtggtcttttgataaccgttggtgtagaacatatatacatttcatgttttattaatatttattaataatttacaaggtcaaaaagatattattttgattgttattttgtattgagtctactgctttacttccattactaaattggctttgcataaatacagtgggccaggattaaccaggattattgagtgtctctgggctttagtgtactatggttttgcatacgtaagtcatattctttctggttttctccatgaaagcca

SEQ ID NO: 8852 - DNA, 292 bp, Homo sapiens
ttttctttgtgacacattttaaataataatcatatatttctccattaaaataattgaaataaataatatgggtgtataccaggaaaatcatcagcatcacacatttcttatacagattagagaaaatataaaactatgttttatccctttagctattcatatagtttatatatatagcaggcatgagagttaaccattttatcctgaatgtcctttatttaacaagaagaaagtatagtaattgtaggctacatttaaagatatctatcaattttaagattaagtagttgtg

SEQ ID NO: 8853 - DNA, 719 bp, Homo sapiens
aactttttttttttaaagaaagtctgatggacaaactaaacattttcccagattatcaaagctgttttgcataattcttaatcttcacaaaaatgctaaaacacaggcatcattattcccgttccatagataagaaaactgaggctttaaaaactgaagataacacgctggtttcccttcaggtaatataaatctttcaacttttactaaaaagtgaacataaactgctcaaggttcattaacaccaggcaccatgtaacataattgattttgatacatcaaaattgatgaataaattaatagatcttagttatttctggtcaaatgatacgacatttgctattcaaaaagatacaacccaaaaacattttgagatgttttccagaatagcagttgtattatcaacactgtgatgcaacttggttaaaaatactggccaggcacagtggatcacacctataatcccagcattttgaggccgaagtgggtggaatgctttgagctcaggagtttgagaccagcctgggcaataaggtgaaactttttgtctctacaaaaagtacaaaacttatccagacatgggtggcatgcacctgtagtcccagctacacaggagactaaagtgggagtcacctgggcccaggaggtcgaggctgcaataagccatgattgtgccactgtactccagcctaggcaatagagtgagaccctgtctcaaa

SEQ ID NO: 8854 - DNA, 328 bp, Homo sapiens
tctgccctttagatcatccttcctttttcatgaaaggtggcacatgtttgtggctgagcagtttcatcagcctgtttcctgcctgtggtattttgggagtctgagagtcttttttgaaattttgtttaaaattttgtcttctctttccccctttcaatttaaactggcagtgtttctgtttatgtaatgttctgaagaacttttggggcctagtacagtggctcatgcctgtaatcccagtgctttgagaagccaaggtgggaggatcacttgaggccaggagtttgagaccagcttgagcaacatagtaagaccttgtctctacaaa

SEQ ID NO: 8855 - DNA, 466 bp, Homo sapiens
atctattcaatattaaaacaaaagtcctgcaaacctcggatggtgagtgtaatacttcagcactagcaccaaagcctcaaatataaacagataccaatatcaccactagcaaacaaaatgagccctcggccaggagcagtagttcacacctgtaatcccaacactttggcaagccaaggtgggaggatcactttaagtcaggagttcaagaccagcctgggcagcatagtgaattcgcatctctacaaaaaatcttaaaaattagcttggggtggtggcacacacctgtagtcctagctacttggaaggctgatgtatgaaaactgcttcagctcaggagtacgacgctgtggtagctatgatcatgccactgcactccagcctgggtgacagagcaagatctagataattacagtctgtcctgctcctgtttatgttaaaatgctttcaatcagcaggataaaaa

SEQ ID NO: 8856 - DNA, 497 bp, Homo sapiens
agttttcttaatagatttgtatgtctgatatgtataaccatttactataatatgttgcaaatcattctaatatatgtaaaacaatattatttgtaatgcagttattggtaaaatattatgtaatgttaattttgttcctagctgctaatttttctgccaaaagtattctaattttcaggttgttttaaaggcttttaaaactttttagttaagttttttattcacgtcatttaaattagttttttgctttttttctacctgataatctctttaacaagatgcaacaagacagaattattaaaattaaacctaaagttaagttacagatttaaaggcattatgatattaagcattaaaattggagattaaaatgtacaaaacagggttttccttatgaacaaaccttacagggtaaattgtttttttttctaaatgtcattaaatttatttgtactcagaactgttactaataaaaattaaaaatgcaaaaaaaaact

SEQ ID NO: 8857 - DNA, 755 bp, Homo sapiens
agagaggtcagatcatttgtccagagcacatgggtaccaagtgacaggccatgatctgaactcaggaacactggctctgatgtgccattctttgccatgtcaccgtagctgccaagagcataggtttccctcttccgaaccctgcctcaagcaatgaaatttctagaaaagtatatgaagttttaatacgatagctgctatggtctgaatgtgccccttttaaattcatgcactgaaacttaatcatcaatgtgataatattaagaagtcgggcccttaggaggtgaatgagattagcgagtttatatgagggctggagggagctagctaggccttttggcccttttgtcctttccagcgtatgaggacaaggcattcatcctctccggaggacacagcaacaaggtgccatcttggacgcagagagcagctctcaccagacactgaacctgccagcaccttaatcttagatcttcagcctccagaactgtgatcaataaatttgtgtgtttttataaattctaatgcaaggtttcttctataaggttattttgtctatgttgaaaatctatgttttagtttagtttacctttatcaatgatcttagctagatctgctggatcacttgctgcattcagttaaagacatcagcacttgctacttcaccttgcactttatgttatggagatggcttctttccttcgacctcataaactaacctctgctggtttcaaacttttcttttgcagcattct

SEQ ID NO: 8858 - DNA, 344 bp, Homo sapiens
caaaggaaaaataaattgaactgcatcaaaattaaaaacttttgtgcatcaaatgacactatcgacagagtgaaaaggcaactcacacaatattagacattatttgtaaaccatctatctccaagggattactatccagactatataaagaactgtaactcaacaacaaaaacaactcaattgaaaaacgggtaacggactagaattgacacatctccaaagaagatatatgactggctcacaagcatatgaaaagctgctcaacttcactcatcactagggaaatgcaaatcaaaaccacagtgaagtaccacttcatgcccattaggatggatgtcataaaa

SEQ ID NO: 8859 - DNA, 370 bp, Homo sapiens
ggtttatatattaaactaataaaaaggtacagggtaaattatatacatatatgtatgaatgtatatatacttagattaagaaaaaaaaatgactcacattcctgtaatataaaggtccattgctagttgaaaagtgacctcttttctctgtacatagtgaagcccgtatgtatggagttttaatctgtacagaaagaaatgtattattcattggtctttctgctgctggaaagataatagaatagctgattcttacaacaactgtatgatcagggatgagttagagtatttcttttgtctttgctcaaagccatacatatataaatatatataaagattattaataaattcaacaaaaaataaactacaa

SEQ ID NO: 8860 - DNA, 365 bp, Homo sapiens
cgctgtggctacatggtaaatcacctctgcattttcctggtccatcataggaatatacaaagcagtgcagaataaaatacaaacatttccacttaaaatgttatttttactttttcttaatatattgtattgtctaataagtttttgatatgctgcaaaatgaacctatctacctgatataatacacaaattctataattcttgtttaaaaagtacaattagacataatttttctatacttgtaattataattatggaatatagttaagtaagtataacatatatacttgtaattttatgtgtgcatataaaacgttatgtatatgtaccattaataaatataaactatgagaaaataataatat

SEQ ID NO: 8861 - DNA, 991 bp, Homo sapiens
acagtgatcacagaaggctttcagagaggcatttgcagccttaaaagagcaagacaatactttgttttgactttcagcgttaatatttggggtttgaaacctttctttgtagtttttgctagttgctgatacatttttttgtctgagaaaggcagggaaatgtgttgtacttcatcattctttctcagttcttcacttgcccttctcattccagtcgttgagctttcttcatggatccattcccacctagaatgccctttctcagtcttttccaaattctaccattcctcttgttcagatcacatcttcttttagaaactttctgagttctcagctctagagactatttcccaagaagttttccctaaaaagtagagaatttgttgttatgaaagaaaaacctggctgagcgcagtgcctcacgcttataccatcacagctctttgggaggccgaggcagccagatcacctgaagtcaggagttcgagaccagcctggccaacatggcgaaactccatctctactaaaaacacaaaaattagccgggtgtggtggctcatgcctgtaatcccagctacttgagaggctgaggcgggagaatcgcttgaacccaggaggtggaggttacagtaagccgagattgtgccactgcattccagcttgggtgacagagtaagactgtctcaaaaaaagaaaaacaaaaaccttacagttctgttagcaacatctatcaatgatatttctgcctaaaacactaaaaaaactaaagaacattaataagtggggccagttgtgtcagctaatttatattattggtgaatttctctgatctagcatgataagtagaaacattaaactgtgatactgttattgtttactgtttgattaatataagctggtccctttgttgaaaacataaagtattgcacatagaacatctttagatatttgggccagaaatttaatttctattcctctagtcctgttacct

SEQ ID NO: 8862 - DNA, 490 bp, Homo sapiens
aggtgacttttaagctaaggcttaaaagtgtcagccttgggccgggtgtggtggctcatgcctgtaatcccagctacttgagaggctgaggcgggagaatcgcttgaacccaggaggtggaggttacagtaagccgagattgtgccactgcattccagcttgggtgacagagtaagactgtctcaaaaaaagaaaaacaaaaaccttacagttctgttagcaacatctatcaatgatatttctgcctaaaacactaaaaaaactaaagaacattaataagtggggccagttgtgtcagctaatttatattattggtgaatttctctgatctagcatgataagtagaaacattaaactgtgatactgttattgtttactgtttgattaatataagctggtccctttgttgaaaacataaagtattgcacatagaacatctttagatatttgggccagaaatttaatttctattcctctagtcctgttacct

SEQ ID NO: 8863 - DNA, 695 bp, Homo sapiens
acagtgatcacagaaggctttcagagaggcatttgcagccttaaaagagcaagacaatactttgttttgactttcagcgttaatatttggggtttgaaacctttctttgtagtttttgctagttgctgatacatttttttgtctgagaaaggcagggaaatgtgttgtacttcatcattctttctcagttcttcacttgcccttctcattccagtcgttgagctttcttcatggatccattcccacctagaatgccctttctcagtcttttccaaattctaccattcctcttgttcagatcacatcttcttttagaaactttctgagttctcagctctagagactatttcccaagaagttttccctaaaaagtagagaatttgttgttatgaaagaaaaacctggctgagcgcagtgcctcacgcttataccatcacagctctttgggaggccgaggcagccagatctcctgacctcaagtgatccgcctgcctcagccttccaaagtgttgggattacaggcatgagtcaccatgtccagcaatagatctttttttttttcttaaccacctgacatatctttatttactgcctacaaacctgtatagatccctttctatagtataagcactaagtttagtgcaggaactttgttttacttgctactcaacctcccctagtatagaacagtgcaa

SEQ ID NO: 8864 - DNA, 262 bp, Homo sapiens
gggtttcaccatgttggccaggctggtcttgaactcctgacctcaagtgatccgcctgcctcagccttccaaagtgttgggattacaggcatgagtcaccatgtccagcaatagatctttttttttttcttaaccacctgacatatctttatttactgcctacaaacctgtatagatccctttctatagtataagcactaagtttagtgcaggaactttgttttacttgctactcaacctcccctagtatagaacagtgcaa

SEQ ID NO: 8865 - DNA, 481 bp, Homo sapiens
acattctgtcccatctccacagtactgaaagtacattcatttatgacacctcaatccatttccactccaaaaccctagtgaaacgaagtgccccactcacttctggaagatggctttcttctttccaaatggagcttcaggaatgcacgggaaaagaggcagcctaagcatttacatgtatccgtgctcccaggctgattcacacaaagcatcagcaacctgcataaatttagcctgtgagggcgattgtgatagttgtgagagtgatgactgatttcaatatgcaagtatttattgggtgcctaaatgggcaaacattggggttatagtgatgaacacaacagatgtagtcttatcatacttttggggattttactttttaaaagtcacaatttgccagttgaggttgaaaggtgtgtcttttcttcccttaggggattataagggggggacaaagaattgagcttaaaggaaaatcatt

SEQ ID NO: 8866 - DNA, 475 bp, Homo sapiens
ttttttgatacatggtctcgctcagttgcccaggctgcaatgcagtggcatgatcatggctcactgtagcctcgacctctaccagctcaggtgatcctcccacctcaggctcctgagcagctggaacgacaggcacacaccaccatatgtggctaatttttgtatcttttgtagagacagggttttgccatgttgtccgggctggtctggaactcctaggtcaagtgatcctcccactttggcctcccaaagtgctggaattacaggcatgagccactgtgcctggccatacttgccttttaattccaactgacttcttagtccagttgatattttcctttgtcctgtttctgttctgtattttttgttatattgcatattgcatattctcctatggaataagaaatgtaaaccagcaaccaaagggcatatccagaaaactgcattaacgtaactggccagtagagcaaatgta

SEQ ID NO: 8867 - DNA, 201 bp, Homo sapiens
tagtctgaaagttaatgccactttaaaagaaacatctttgataatgagcttacatttaaaaatgaagagttgtatgggatgtagcaccatttcaggattgtggagcagagataggcaaactaatggctgcagaccaaatctgaccacaccagtttttgtgaataagtttttgattggaatgaagctattcatttgcttata

SEQ ID NO: 8868 - DNA, 1587 bp, Homo sapiens
gcagcattgtgacatcaccgtgcactagccaatggctgcctgcctaagctgggtccctggtctcctgggactactagccctttgttgatagggagaagccaacatctcccgcaggaccccctaatcttcagggcagctcccagagcatggatccctcctgattccactcagcccgatgttcctcacagtcaagctgctcctgggccagagatgcagtctgaaggtgtcagggcaagagagtgtagccacgctgaagagactggtgtccaggcggctgaaggtgcctgaggagcagcagcacctgcttttccgtggccagctcctggaggatgacaagcacctctctgactactgcattgggcccaatgcctctatcaatgtcatcatgcagcccttggagaagatggcgctaaaggaggcccaccagccgcagacccagcccctgtggcaccagctgggactggtcctagctaaacactttgaaccacaggatgccaaggccgtgctgcagctgctaaggcaggagcacgaggagcgcctgcagaagataagcctggagcacctggagcagctggcccagtacctcctggcagaggagcctcacgtggagccagctggagagagggagcttgaggcgaaggcacggcctcagagctcctgtgacatggaggagaaggaggaggcagcagctgatcagtaaacgggccatcctacccatttgcatgctaaaattctcccggcctcatccttacgtgttccctggtgacttttcctactacttcctgctgatgtggatgcgtccacacccctttttgaaccttccaagcagctggagggtttttggatccctgtcccctcttgggcctgaggtcctccctctgaaatgcagagtgaaccaaccctcatcaccatgcttcccctagaagggttctgatcaccggagggcagccccaaaggccacagtcccctcctgtgctggcagctttgccacacatacccagcagctccccaggctgaaagcagccctggcccagggtctccatggttctaggcagaccctctttctccttcgggacagaaagacaatgtgagttcattttcctccatcctcagaccgtgacatctcccctaggctccccagcagccaagaggagaggaatgtcaggtagctgccccttgccttctgggtgaggctgcccctgctgttctcctgcttgtgttccagcttaagggacaggcacagcagaggtgagagtgggaggagggcacgtaccgggtgccagccctggagccctcagggagacagacacagaccaagaatagcaggaaactgagcctcaggcagaaaaaaagttcagcaaagtcatacactccctgtggccagcgtgaacagagccatgccccaccctcccagactgatcagtcagtaggtatcacagctcacattacctgcccagcgctcccaaggctccctggaaggaaaaatggtatctgtcaatgaggatccttgccctcacagagcacgcagcctagatgcagagagctgctatacatgtgaaaagtaaagtggtgacatgaaactagagt

SEQ ID NO: 8869 - DNA, 398 bp, Homo sapiens
tacctctggagcttctccttctccaaacacctgaattttcattactgttggtgataggttttaaggtcatttttgtaaaagagagtatgatgtccatgaaataatgtgagaattacaatgctaattatttcagtccgttcttcagaatgtctaagtacactggaaacccagaaagcatttattttgttcaatgtggagaatacatcataaccagctcaaacactgagggcttcccaaaaggagtgaaagtaaattcactgttcacaagtctttctaataatggtaatctggccaaaagctaaatattatttggaatagttcatggggaaagttttttcatacctcagtctggtattttgttgaactcctttccaataaaatttactataccaaataat

SEQ ID NO: 8870 - DNA, 328 bp, Homo sapiens
gctccttccctgaccaggagtgatgcctccttctactttgccactgcttctcatatttcctcaaggagaatctgtgaactcagaatcaactcctccctgactcctctaactcttctagggtatcatggggagagtttgtggtgggtttttgtagaaagaagtaagatagatatattttcattcaatcctttaagtgagtaaagaaaaggaaaacagtttaatttctgtattaaagttttgaagattcagattttgccacttgtgaaaatatctttcagaaatgcatgctgtctagatgcacaattgaaatatatatttgaaaatgttg

SEQ ID NO: 8871 - DNA, 213 bp, Homo sapiens
ggagtttgagaccagcctgggcaatgtagcaagacctcatctctacaaaaagtttttaaaaattagttggacatgatcgtgcatgcctatagttctagctatttgggagattggggcaggaggattgcttgggcccaggaggtcgagggtgcagtgagctatggtcacgccactgtactctggcctgggcgatggagccagactctgtctctt

SEQ ID NO: 8872 - DNA, 1527 bp, Homo sapiens
ggcatatatgtagaaaatgttagttttatatcaaaatatggaaacctcatccagatagaaattctatgagtttctttggactctgttctaagttttttttgttttttgttttttgttttctttttcatattggactgaaatctgccaccctgtaacttccaactattggttctagttctgttctctggagcagcatggagtaagtgtcttctattagaaggcatctgtcaccttttctagactgaatttctccaggtgtcctcccctttttatatgaaattaaaacccatatctctgaccttcacattgattccctttggaatcttacaatctaatatgaacttcctagtttatcagtgttttccctaatacagttaaaatatgatagccccaaattttaatttaattctatactatatttctatgttactatgcacaccagtacagaataccttgtactatagaccattaatcagagactgagttaattagtgcagcttcaacattttttttttctttctcttagctattcttagttgttggctcatactaaaatgtggtcagctaaaacctatcagctaaataactgttggggctcttctttttttagtaggtgtttctgccttagtaatgtggctttaccttgtggaattgagtgtattattcagaaaacctagaacaagaaatacacttttatatgctaacatctgtaggcctttggttttagtgatataggctttcagtttaaaagttaaaataaacatattcctgtaagaactttagctagaaattcatttgattgctgttttggaaaatgtttttgtctctttgaggtttaaatgtttttaattgcaaagcatctgatttgtgtcttcttttacaaaacatgctattatatatttaaaagtaactttgtataatgaaatgctccctgtaagctggaaaatgtatctaaaataatagatattccattgtaggttttgtaccctggaacagaacttctcaaccctcagcactattgacatactttaaataattctttgttatgcacggctgtcctgtgcattgtaggatttgtaacagcatccctggcctctatccactggatgccagtagctcacatatcaccacctcctctgcagtttggtcatcaaaaatatatgcagatatggccatatgtcccctgggggaaaaattcccccagttgaataccaactgtcctaaagcaacagaagtattttttaatcagctggtcagtagtttctaccttaaatttctttctgtaattgggctagaatagaatatttttcttatggtttctttgtagagatttgtaaaactgtacaacataataaagaacttcacatgtaactaacactaaagttcctaatttggtcagttttttcttttcttcctaatactgttttttatcctagtttttaattcctgttatgtgatacaatctatgatctgaaacgtgtgactatataatgtattgagattaaagaatgaaaatttaaaaaaaaa

SEQ ID NO: 8873 - DNA, 430 bp, Homo sapiens
aggcaggaggcccaagatagaagcagaaataggcatcatatgatggtcacctactgttttctcttagagaaagacaataaataacccatgggctgacactaacataactatgatggcaacagttacacaccacttctgatggaaaagtgtatgcaaccagagcaagaagagcaagaagaaatgagtgcttttctgtcctttgagaccctgatgagccctgacaaagttgtcctcttcaaggagaagaaagggatagaatggcctctggaaatttaaagcaagggttagcaaactatagcctctgggacaaatctgtcctgctatctttttttaatagttgaaaaaaaataaaagaatactttgagacacaatattatatgaaattcaaatttcagtgcttgtaaataaagtatttttggaacgcagcaaa

SEQ ID NO: 8874 - DNA, 1901 bp, Homo sapiens
  misc_feature (1031)..(1031): n is a, c, g, or t
  misc_feature (1121)..(1121): n is a, c, g, or t
  misc_feature (1599)..(1599): n is a, c, g, or t
ctacagtttaaattctgatttttctggctacaagtttctaaaataagttgtgcttccttaaagtcctatgaactgaaaactagatgttttatcaggcgctgcctctaaaccccccaaccatcacagaaggaaatctcttcactgctggcattgacaactaataactgagggtgcccggaatccttcaccccatgtctagtgagtctacggaaccagggtaattgagacaatatctgttacaggaatcaactcctggatacatcacacttgagtcaaagcctggaaagctgaggaagcaacccctgagagcccaaaggaacgtcctaaatataatggaaattatttactacgccttgtgggaattgctttactctactatttgcagtaggactatatactatagcaccttcagggtggaatatctgacagggaatctcaattgctgtagcattttgcttaattattatcctcatagcaggaataactgttactaacaaaagataatatgtgggcctttccaaacatgtgcctctgcctctcattaggtagggaatgttgtttctatctcaaccaatcaggcctagtaagagactgctgaaaaacttaaaggtctaaaaagctaagggaataccaaaacaaccagacagattcttggtttgggagcagaatcatagcatgggtcaccccattcctgggccctctcctaataatatgcctaggactaatgttcttaccctgcctaattaacctttttcaaagatttttagctgacagactcatgaccatttcacacacaactacccaaaaacatctacagtgttatttctgcagtcaatccaagacccaaaaactgtctgtccccttgtcagcaggaagtagccagaaagaacacactgcccctcgtcatttttataactacagggtctggattgacagagcaggagcatcaccctcttcgacttcgacgaggaccatcattttaagtttcaccttgatcaaaacccaccaaaatccaaagggcatcagccttntggttaaggtcagcatgaacataaatcacacaacatctctgaccagaaacattcgaaacccctcccggaccagagacatgccagccccgngataaccttccccctggctggagagatgtcagccccaagataacctcccttctgaccagagacattccaaccctaccataagcttctcccccatgcagaaacattccaaacctgtaataagttctgtcaccaataaatactgtaagtctgtaagagagagctttcctgactgaaatcagccagaagcctctctcaggtttattctccaaaacaaacctgtctttgactgttgagccactttgtatttctttcctctttaacttacactgtgaccttacaaaacactcttattcaaaaaccctccaaaagtcttgaatttgagtgaatacctttttatagatccaaagagatgttaacgtgcttgttccttttcagtctttcttttctagtacttgggtagactttcctttggttggggagcggggtgcttaccatataacttgtaaaccaaagcatgaaatatatgtttctgtttaancatcaaaagtcttttgctgggcacggtggctcacacctgtaatcccagcactttgggaggatgaggcgggtggatcacctgagttcaggagttcaagaccagcctggtcaacatggtgaaaccccttctctgctcaaaatacaaaattagctgagcgtggtggtgcatgcctgtaatcccagctactccggaggctgaggcaggagaatcgcttgaacccgagaggcggaggttgcagtgagccgagatcatgccattgtactccagcctgggcaacaacagcgaaactccgtctcaaaaag

SEQ ID NO: 8875 - DNA, 344 bp, Homo sapiens
aatagctaatacttctggagaagaggatccattttctatgttatactctttcatattttaaaaaaacaagcacacggctgggcatggtggctcgtgtgtataatcctggcattttgggaaactgaggtgggaggatcgcttgatcccaggaattcaagaccagcctgggccacatagtgagactcccatttctacagaaaaaaaaaaaattgccaagcatggcagtgcatgcctgtggtcctagctacttgagacgctgaggcagtaggattgcttaagcctgggaggttgaggctgcagtgaactgtgattgtgccactgcactccaccctgcctcaaaaaaa

SEQ ID NO: 8876 - DNA, 1395 bp, Homo sapiens
aagccactgtaccccacctctgtgtttgattttaaggggaattggcccaaaaaataacatttatattatttcttcactatgattcacatgtccctcagaagcctctaattacaatggaattcttaaaaaaaattcacatttctcagcaaagctttccaacgaaaatttttatgataatcctttgtcatataagttaaaatagtaaaactagacaatagtgagtaagtattatatttgagacacctgctaggcatctgatataaggtggatgagaggatcagtgtcctttgggagtttaccctctagggaagcaactacatgaaaagttaaataaattataaaaatcacattttgaattgataaaagttatgagacagaacataatttggtttttatttatttttttgagacagggtctcactttgtcctccaggctggagtgctgcggcctcaacctcccaggttcaagggatcctgctgcctcagccccccaagtagctaggactacaagggtgcaccaccacacccagctaatttttgtattttttgtataaatggggtttcgccatgttgcccagactggtctcaaactcctgggctcaaaatctgcgtgccatggcttctcaaaacgctaggattactggcgtgagtcaccatgcctggcctataatttgttaatatggttgttactacaaagtttaaaataaattgcccatgcattcctatttataataggtgagtggaggacacttcaatctaaagtgatcttaaaggaggagtagtaggatttgaagatgaagaaagaagaggggaggtaaattactttccatcacttcaatttcaacccatcagataaaacctctctttagtaaacctgcatgtgggtggagctgtaacagcaattaaggacagtgtgactctgttcttctgactttgggaaaaccagtttggctggaacaaaaagctgatagagaagactaatggaagataaggttgaaaaggtaggtttgagggagctttgttacaggaaaaaaaaaaaaaaaaaactgggctttgtcctgtagacagtggagaggtactttagcagatgtaagacattaccattataggaaagcctctgaagtaacatacactgtggtttttcctgttgctgaaaatatgcccagagtaacaagatgtggcatagttggttatgtgtcttataaccagtgaggtgtgcccaaatgggaaattaatgaatgactacccaaaaagaagagggagagtgtttgaaacactgtcactgtgaaatagactggttgtatgaaaagttgcatatcaagcctttggcaaattatataaatactctgattttgacatcttaaaggagtatactatagaaaataaaagaaaaac

SEQ ID NO: 8877 - DNA, 1131 bp, Homo sapiens
gccgcgggggccattgatacagaggcttgctgcgcttggtgtgcgcggcccggccgggcctctggaaacgcccatgagaaatgagctcatgctggatgcgcgcgctccttgggcgcaactgcccagcgcaaaacgggccccgaaagcagggtctcactttgtcctccaggctggagtgctgcggcctcaacctcccaggttcaagggatcctgctgcctcagccccccaagtagctaggactacaagggtgcaccaccacacccagctaatttttgtattttttgtataaatggggtttcgccatgttgcccagactggtctcaaactcctgggctcaaaatctgcgtgccatggcttctcaaaacgctaggattactggcgtgagtcaccatgcctggcctataatttgttaatatggttgttactacaaagtttaaaataaattgcccatgcattcctatttataataggtgagtggaggacacttcaatctaaagtgatcttaaaggaggagtagtaggatttgaagatgaagaaagaagaggggaggtaaattactttccatcacttcaatttcaacccatcagataaaacctctctttagtaaacctgcatgtgggtggagctgtaacagcaattaaggacagtgtgactctgttcttctgactttgggaaaaccagtttggctggaacaaaaagctgatagagaagactaatggaagataaggttgaaaaggtaggtttgagggagctttgttacaggaaaaaaaaaaaaaaaaaactgggctttgtcctgtagacagtggagaggtactttagcagatgtaagacattaccattataggaaagcctctgaagtaacatacactgtggtttttcctgttgctgaaaatatgcccagagtaacaagatgtggcatagttggttatgtgtcttataaccagtgaggtgtgcccaaatgggaaattaatgaatgactacccaaaaagaagagggagagtgtttgaaacactgtcactgtgaaatagactggttgtatgaaaagttgcatatcaagcctttggcaaattatataaatactctgattttgacatcttaaaggagtatactatagaaaataaaagaaaaac

SEQ ID NO: 8878 - DNA, 1214 bp, Homo sapiens
gccgcgggggccattgatacagaggcttgctgcgcttggtgtgcgcggcccggccgggcctctggaaacgcccatgagaaatgagctcatgctggatgcgcgcgctccttgggcgcaactgcccagcgcaaaacgggccccgaaagcaggtgaggggaaatgccgtcaggccggatatcctgaagcctccgaggaaatgggggggtcagaggagcccgtggtagctttggatcttttggaactagggtgatctataaaagtgcagcttgagaagatttcatacataagaccagcgtccattgttctaccatagaaccagttcctttggtctgctttagaacagtgaggtatggctacgtcaagataacagagaaagtagaacagacagttgccatcctgattgtaatccagtggtgcctgtaatttctacctgcagagtcatctctttctgttaagatgctgtctccagaaagcacatgttaaaggacctatatttgatcagattacctggctcttgctttgaaacactgatgaaggacttgggacagaacaaagtgagtggaggacacttcaatctaaagtgatcttaaaggaggagtagtaggatttgaagatgaagaaagaagaggggaggtaaattactttccatcacttcaatttcaacccatcagataaaacctctctttagtaaacctgcatgtgggtggagctgtaacagcaattaaggacagtgtgactctgttcttctgactttgggaaaaccagtttggctggaacaaaaagctgatagagaagactaatggaagataaggttgaaaaggtaggtttgagggagctttgttacaggaaaaaaaaaaaaaaaaaactgggctttgtcctgtagacagtggagaggtactttagcagatgtaagacattaccattataggaaagcctctgaagtaacatacactgtggtttttcctgttgctgaaaatatgcccagagtaacaagatgtggcatagttggttatgtgtcttataaccagtgaggtgtgcccaaatgggaaattaatgaatgactacccaaaaagaagagggagagtgtttgaaacactgtcactgtgaaatagactggttgtatgaaaagttgcatatcaagcctttggcaaattatataaatactctgattttgacatcttaaaggagtatactatagaaaataaaagaaaaac

SEQ ID NO: 8879 - DNA, 630 bp, Homo sapiens
agagacgctggtgaaactgcacggctgggcgccgccgccgctttgtgattggctggaaaactccgctgggagcgtacctccttcggtgattggtgaagagaagggggcttccgaggacagtctggccagtcaggacttcccctccctctccaagagtcatctctttctgttaagatgctgtctccagaaagcacatgttaaaggacctatatttgatcagattacctggctcttgctttgaaacactgatgaaggacttgggacagaacaaagtgagtggaggacacttcaatctaaagtgatcttaaaggaggagtagtaggatttgaagatgaagaaagaagaggggaggttaaaaaatggaggcaacagctgggtacagtggctcactcctgtaattccagcactttaggaggccaaggctggagtgcaatggtgcgatctcgactcactgcaacctctgcctcccaggttcaagcaattctcctgcctcagcttcccgagtagcttggactacagaactgcttacaatggctaagatttggaagcaacctaagtgtccaacagaggaatggataaagaaaatgtggtacatatacacaatggagtactattccgccataaaaaaga

SEQ ID NO: 8880 - DNA, 815 bp, Homo sapiens
gccgcgggggccattgatacagaggcttgctgcgcttggtgtgcgcggcccggccgggcctctggaaacgcccatgagaaatgagctcatgctggatgcgcgcgctccttgggcgcaactgcccagcgcaaaacgggccccgaaagcaggtgaggggaaatgccgtcaggccggatatcctgaagcctccgaggaaatgggggggtcagaggagcccgtggtagctttggatcttttggaactagggtgatctataaaagtgcagcttgagaagatttcatacataagaccagcgtccattgttctaccatagaaccagttcctttggtctgctttagaacagtgaggtatggctacgtcaagataacagagaaagtagaacagacagttgccatcctgattgtaatccagtggtgcctgtaatttctacctgcagagtcatctctttctgttaagatgctgtctccagaaagcacatgttaaaggacctatatttgatcagattacctggctcttgctttgaaacactgatgaaggacttgggacagaacaaagtaagctttgatggaagacaggaaaggtctagatagtgtttgcagattcaaatggctacagaggccagacaagtaaagcaaatgagtgagactggccttgtgtaagacaatggggaatgatagggaaaatggcaaattggaatatccatgccataactaaaaggaacagctgctcaactctagcagattgttgccctcaggaatgtgggtccagtgttctcagatgttcaatttttttcctcccaaaagaaaccccaaaat

SEQ ID NO: 8881 - DNA, 2162 bp, Homo sapiens
ggctgtcacccgcaccggatctgcttccagggcttggtttcgctttgcctggctcttggctaggcctggcgccccgcgcggagccgagcaggtggcagccgaggagtggcgggggctggaacatttaaccctttgggagcacctgccctctcccagagggcgcgtccccggatcaggcccggtgccccgcagcgcgcgtgggtcctggctggctggaaggaggccctgaccttgctttctctcccgtgccaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaag

SEQ ID NO: 8882 - DNA, 849 bp, Homo sapiens
gataactttatttgccaaattttgtaatttggagcttaagaaccactgtttttcctcttgagttctggcctgtaccaagtgcagaaatagcttcccaaaggaaaaaaatgggcaacagtaccaaatgctgctgagaggtcaagaaagaagaaggctgagaactgattactgaatttggccacctggaggtacttggggaccctgacaagaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgaggtcagcggggagtccttccttcccccggctgagaggacatagtaacaattacaatgagtaacctcatgagggtgaaaaatactcctacatcgctgatgagcaaactgaatttcagaaagatgaagtaacatgcccaaggtcaaagagctaataaggagtggagctggctgtcaaacc

SEQ ID NO: 8883 - DNA, 527 bp, Homo sapiens
gataactttatttgccaaattttgtaatttggagcttaagaaccactgtttttcctcttgagttctggcctgtaccaagtgcagaaatagcttcccaaaggaaaaaaatgggcaacacatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaagaccc

SEQ ID NO: 8884 - DNA, 348 bp, Homo sapiens
actgtgcaagctgggatctgtccagggatactgcctcagagaggcaatcatgggtttcttcctctccctccacacaggtttggaataaattgcctcatccaatttgaagacttcgccaatgccaatgccttccgcctgctcaacaaataccgtaacaagtactgcatgttcaatgatgacatccaaggtaggtttccaccccacctgatgaagctacaggggactaacttatattctcaacctcactgggatgccaaaggggtgaggaaaggctgtcaccccatagttggtttgctgccagcagctgttgaaaaaagaatattaaacttagattcaactcctaattgg

SEQ ID NO: 8885 - DNA, 629 bp, Homo sapiens
attgacaggggaattaatggctcttataagcatattcaaattagctccctgaccctgggtggcacaggtccccatccctcaactgagcttggtgctggatgccttgggccaaagggtcttggtgagactcaggcattgcccaaaagcctttctgtcctggcccaggaagccataatcctaacagctcaaataaattctttatggattctccatatgtggtttgggttaaagaaacatgcacacacacacacaccccactctcacacttatgtcccaccataggttctgccaggaaatgtagtcaagaagatgggccccaaaacatctgacagctcaaaccaaagcatggggctcagcaggaaacgctctcagagtttccaaatgcatctgtactcctacccaacaggccatcacgaccacaactgctctgtgttccttttcctgtaggggaggagccacctgaaccatgaaaaggagatgtttgcccaagaccatcctgaagtcaactccctgtgagcagcgttggcacacgcaaaaaagaaaaccaaagtggtccacaaaacattctcctttccttctgaaggttttacgatgcattgttatcattaaccagtcttttactactaaac

SEQ ID NO: 8886 - DNA, 299 bp, Homo sapiens
gacgatggtgtgcgaccagacacagccaaccttatgacttggtagataagatgggcagctcaggccatatggtcatttaatgcctcatggtcaggttgtgttctcatttttttaaatgtttttatccatttagcccttatataattctatgaggctcatgcttctttttgtcttccattatatttatccttgtcattttctttatgaatgatgatggtagcagcacctggctatctgatcccatcttatggggtcaagtaacaaatcaggagctgtttctcaacttcaacaacaaaaaa

SEQ ID NO: 8887 - DNA, 2257 bp, Homo sapiens
ggctgtcacccgcaccggatctgcttccagggcttggtttcgctttgcctggctcttggctaggcctggcgccccgcgcggagccgagcaggtggcagccgaggagtggcgggggctggaacatttaaccctttgggagcacctgccctctcccagagggcgcgtccccggatcaggcccggtgccccgcagcgcgcgtgggtcctggctggctggaaggaggccctgaccttgctttctctcccgtgccaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaagaccc

SEQ ID NO: 8888 - DNA, 2164 bp, Homo sapiens
aggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaagaccc

SEQ ID NO: 8889 - DNA, 1531 bp, Homo sapiens
  misc_feature (15)..(16): n is a, c, g, or t
  misc_feature (23)..(23): n is a, c, g, or t
caggctggtacgccnnggagtantgggatatcgtcgaacccacgtcgctccggctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaagaccc

SEQ ID NO: 8890 - DNA, 1283 bp, Homo sapiens
gataactttatttgccaaattttgtaatttggagcttaagaaccactgtttttcctcttgagttctggcctgtaccaagtgcagaaatagcttcccaaaggaaaaaaatgggcaacagtaccaaatgctgctgagaggtcaagaaagaagaaggctgagaactgattactgaatttggccacctggaggtacttggggaccctgacaagaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaagaccc

SEQ ID NO: 8891 - DNA, 1523 bp, Homo sapiens
aggctcaaggcatcctcgaatttcttcttgttggagcttcctggatcgccatgtgggggagtcacacctgtgttggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaagaccc

SEQ ID NO: 8892 - DNA, 2114 bp, Homo sapiens
ggctgtcacccgcaccggatctgcttccagggcttggtttcgctttgcctggctcttggctaggcctggcgccccgcgcggagccgagcaggtggcagccgaggagtggcgggggctggaacatttaaccctttgggagcacctgccctctcccagagggcgcgtccccggatcaggcccggtgccccgcagcgcgcgtgggtcctggctggctggaaggaggccctgaccttgctttctctcccgtgccaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcatagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaagaccc

SEQ ID NO: 8893 - DNA, 1071 bp, Homo sapiens
gataactttatttgccaaattttgtaatttggagcttaagaaccactgtttttcctcttgagttctggcctgtaccaagtgcagaaatagcttcccaaaggaaaaaaatgggcaacagtaccaaatgctgctgagaggtcaagaaagaagaaggctgagaactgattactgaatttggccacctggaggtacttggggaccctgacaagaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaagaccc

SEQ ID NO: 8894 - DNA, 1307 bp, Homo sapiens
attgacaggggaattaatggctcttataagcatattcaaattagctccctgaccctgggtggcacaggtccccatccctcaactgagcttggtgctggatgccttgggccaaagggtcttggtgagactcaggcattgcccaaaagcctttctgtcctggcccaggaagccataatcctaacagctcaaataaattctttatggattctccatatgtggtttgggttaaagaaacatgcacacacacacacaccccactctcacacttatgtcccaccataggttctgccaggaaatgtagtcaagaagatgggccccaaaacatctgacagctcaaaccaaagcatggggctcagcaggaaacgctctcagagtttccaaatgcatctgtactcctacccaacaggccatcacgaccacaactgctctgtgttccttttcctgtaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaagaccc

SEQ ID NO: 8895 - DNA, 2174 bp, Homo sapiens
ggctgtcacccgcaccggatctgcttccagggcttggtttcgctttgcctggctcttggctaggcctggcgccccgcgcggagccgagcaggtggcagccgaggagtggcgggggctggaacatttaaccctttgggagcacctgccctctcccagagggcgcgtccccggatcaggcccggtgccccgcagcgcgcgtgggtcctggctggctggaaggaggccctgaccttgctttctctcccgtgccaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacactggacagctacacttggcccaaggaagccatgaatgttcagacggtctgaggcagtctcagaggctagtatggggctagatgaagcccagagtaacacccacaatataaatgggttccaaaatggcccaagtgaatccttgtcgctgtgttttttcttttaaactttctggtgtgagaggagatgccaaggcatacagtgaataaaagccttgtctctgaagaccc

SEQ ID NO: 8896 - DNA, 1346 bp, Homo sapiens
ggctgtcacccgcaccggatctgcttccagggcttggtttcgctttgcctggctcttggctaggcctggcgccccgcgcggagccgagcaggtggcagccgaggagtggcgggggctggaacatttaaccctttgggagcacctgccctctcccagagggcgcgtccccggatcaggcccggtgccccgcagcgcgcgtgggtcctggctggctggaaggaggccctgaccttgctttctctcccgtgccaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggtaggtttccaccccacctgatgaagctacaggggactaacttatattctcaacctcactgggatgccaaaggggtgaggaaaggctgtcaccccatagttggtttgctgccagcagctgttgaaaaaagaatattaaacttagattcaactcctaattgg

SEQ ID NO: 8897 - DNA, 1201 bp, Homo sapiens
aggttgtgggaccgctctttgaggaactcaccagctccgcgagctcgcggccgccagcgcggtccacccattggcgggagaggactcacagaccgcagctcctcaccccgcctgctccgcagcgggaccgcgtagacctcagctccccgagcagcgcaggtctgccaaggaccatgggtgccgcgctggggacaggcacgcggctggctccctggccgggccgggcctgcggcgccctcccgcgctggacacccaccgcgcccgcccaaggctgccactccaagcctggcccggcgcgccctgtgcccctgaagaagcgcggatacgatgtcaccaggaaccctcatctcaacaaggggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccggtgagcccccgtggagtgagggctctgggaggggctgcctcatagaggggaataaattctttccgcccttcatgcatattgggactctggaggctaactctgattgggtcagtggtccaacaaaaagacatttgatttcaagcacttgctcagaaaaatgaccccgtaagcagagaaatgagtgaaaagagtagctagcaagggtttattgactcttcttcacctccaaataataaatgcccagcatgctcagagttggcctgagagagagttcaggttgtatttctctcattatctacctgtcacttctctcaccccctctggtcacctccaaagtaccaacagctctcctgccaattcaggccaatgaataatggagtgttggataccaaagactgaattcttttgatgtttgaaaaaccagcatatcttcctttgggcttgactcagattccactttaaatgtcattttattagacaaaactttggcactccattttctctcagagccaaagaattttgaggagttttctaaagcaatcaggttttttttcaaaatga

SEQ ID NO: 8898 - DNA, 778 bp, Homo sapiens
ctatgaggctcatgcttctttttgtcttccattatatttatccttgtcattttctttatgaatgatgatggtagcagcacctggctatctgatcccatcttatggggtcaagtaacaaatcaggagctgtttctcaacttcaacaacaaaaaagttatctgcaaaagagagcatggatttgcaccaaaacttgcatgcctacagggcataagggctaagaaaagttgcctgttcctccacagtcccagatgtggggaactctgccaagggtcttctcttgggagctggcggcctgtggccagaggttgatctcaggccactctgtttcaggcacagcctccgttgctgtggcagggatcttggctgctctgcgaatcaccaagaacaagctttccaatcacgtgtttgttttccaaggtgcaggcgaggtatgtggcattgagggtttctttggttgctccaggaagagaataagaatgggtggaagcataccaaaaaagggaggcattctggggttctgaaaagaggaagcagcacagacatattgtgatcattgcagctgcctaggctctgacaattgggtgtctcaaggcaaggacttaattgggcctcctgggagtcattgaggtgggggaaagaaaagggggtccttatggcaagacatcagataaatgttcagcagctgtttgccctgtgtctgaacatctaccctatggtaccttccaggcagctatgggcattgcccacctccttgtcatggccctagagaaagaaggtg

SEQ ID NO: 8899 - DNA, 386 bp, Homo sapiens
tctcctcccaccttctggttcttcctaataatcctggatacttgttggaaaaaaaaaaaacaggaacaccgggagtaggctcagtcaatgggtgctgtctgttccaggagctgctcagagaccctctgtacatcggcctgaaacaccagcgcgtgcacgggaaggcatacgatgacttgctggatgagttcatgcaggctgtgacagacaagtaagtggaccagtctgtcccttttgaaagaggacttttaagagatgccgtgactaaagtcaacactggttttggctgatatacaaagtaaaggcagtagatgcatgcttttccaggtattctgaaaattccaacttgacccctaggagtgataagactggacaccaaatgggct

SEQ ID NO: 8900 - DNA, 4157 bp, Homo sapiens
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctgttgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaac

SEQ ID NO: 8901 - DNA, 2934 bp, Homo sapiens
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtga

SEQ ID NO: 8902 - DNA, 3065 bp, Homo sapiens
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagcttctctccaagataaaatggcaaacccaaaagagaaaactgcaatgtgtctggtaaatgagttagcccgtttcaatagagtccaaccccagtataaacttctgaatgaaagagggcctgctcattcaaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtga

SEQ ID NO: 8903 - DNA, 2258 bp, Homo sapiens
  misc_feature (1482)..(1482): n is a, c, g, or t
  misc_feature (1491)..(1491): n is a, c, g, or t
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagagatgaagagttacctaagtcagtgttataagatgttccatggtaaaagggatttgaagacaaattttggaaatgctgcatactgtatctctcttgaagactcctaaaggtgtcatgaagaaaactgtttacctaagtggttcctaacactgactgaacatcaggctttcctgggcagctttaaaaattctgatgcccagactttatgtggactaattaaatcagaatttctggttgcagaagcttgaaccgcactgttttttaaaacttccccaagtaattctatgtccagtcatttaaatactggtccccacaacccaaaacacattaccctctattaacatcaaagattatgagatggtttgaatagtcatagaacttttgaaagaagtaaagaagaagggaagaattacagttaaccacactccttaaggataattgttctggacagctagcttccccacattgctgagggttcacttttttttggaacctaaaactttacttagttcagtaattttggatagaaatatttctaaaagttatggcatatattttttatatccttaaatagaaaatgccacaattcttagcatgaagaatccttgctgttgactcattatcaaccttataaacaataagtattacaagcctcatgagatatgtacatggtttgtccttataccagataatcctagacatctgtttctagagtacccaagtgtgcttttagttactttccaaatcattgttgtcagtcagattgtcatcttatttcttgtttttgtcagtgcacctttgcatattgcttgctcctttctttgatgcttttcaattgctattatcttgaaaacngatattatngtttgaatttggggcaaagtaagagtagcagggctttaattacgccctaagatgtccccttaactgtggaaaacatcgagttttatctagttggtgaatttttttacttcagaatttatttttttctgtcataaattttgctaaggatctgcattttgagtagaatgaagtggccagatagttgaataatggtttggtgaatatctatatgtatatatgtatgtgtatgtgtgttacacatacatatttaatgacatgaagtactttggttgcttggaattggacagaaataacagtttttttttttttttgggacagagtcttgctctgtcacctaggctggagtgcaatggcgcgatctctgctcactgcaacttccacctcccaggttcaagtgattctcctgccgcagcctcccgagtagctgggattgcaggcgcctgccagcatgcccgccagcacgcctggctaatttttttttttgtatttttagtagagatggggtttcactatgttggccaggctggtcttggaactcctgatctcgtgatctgtgtgccttggcctcccaaagtgctgggattacaggcgtgagccaccgcgcctggccagaaataacagttttaataaatttcatgaaatcactttcttgtatgttaaaggaaacagaaagggttcatttgtgcatggtttagtctttcttttgaatgtggaagtttttcttcttatttgtgtgtctaaaaaaattaaaaagtgaaacattttcc

SEQ ID NO: 8904 - DNA, 1018 bp, Homo sapiens
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagtttttggagccgtgagggatacagcagtttggtcaatattgtcttaacatgcttcaaataaatcagattgaagaactcccttcaggatttcttgtagaacaagtctggtgttgatgaaatccttcggcttttgtttgtctgggaaagactttatctctccttcataattaaaggatattttcaccagatatactattctagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagagatggcaacacttgaatggattacagggactctggagccaaagatccaaggagatgctcttttccttgtcagaacccagattaatcattagcttcttaaggcagggaatgaaaggtgaagtccaagaaacagatgaagagttacctaagtcagtgttataagatgttccatggtaaaagggatttgaagacaaattttggaaatgctgcatactgtatctctcttgaagactcctaaaggtgtcatgaagaaaactgtttacctaagtggttcctaacactgactgaacatcaggctttcctgggcagctttaaaaattctgatgcccagactttatgtggactaattaaatcagaatttctggttgc

SEQ ID NO: 8905 - DNA, 1231 bp, Homo sapiens
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtttgtatgtcttttttggttttgttcttaattattattttatccatgttataaaagtttctcacactcaaaagagtattttcattgtaaatctaattgaccttgggcattgtgcatggaatttagataaagcaggttcacaaggaatatttaaattaataacttaaagaaacccagttttcaggaactagttttttttttttttcccctaccccacaaacgtaaaagatctgaaggaactagtttttattgtgtcatgagggccctgtatttgttgcagggaagaccaagtcttaaagtcatttcacagtttatagtgttgactttctcattcatttaccaagcagagctcagtttttttcttgatttgtctaaatacattagtgaacatgaatgtttgtaatttatagggaaaaaagaaaaaatgtaaataatgtaatcccagaatttgccaccttttatattttcatgtactttacattctttttttctttgcatttaaatatatttaaccaagttgaagttgtcctttatatgcagtttttgtagtactttatgaaggtatgatagacatacagtaaaatgtacaaatcttaagtata

SEQ ID NO: 8906 - DNA, 847 bp, Homo sapiens
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagcttctctccaagataaaatggcaaacccaaaagagaaaactgcaatgtgtctggtaaatgagttagcccgtttcaatagagtccaaccccagtataaacttctgaatgaaagagggcctgctcattcaaaggcagtataactccaactgtggaactgaatgggcttgctatgaaaaggggagagcctgccatctacaggccattagatccaaagccattcccaaattatagagctaattacaactttcggggcatgtacaatcagagcctcacgtgatcaccactcagatcgagatacagaatgttcccaatcacctctgagagtttcctcagacctctttgtctttgacacatccttctcccagaaataatcactattttattatcatagactagtttttgcctgttgttgaactttttatatctagactcatacagtatttatgtgcatctggcttcttttactttgtataatgattttcttgtttggggattcatccatgttgcttatatc

SEQ ID NO: 8907 - DNA, 4617 bp, Homo sapiens
ccatgggaatattgaattatagagttggacaggatagtcttatttattgttgcatagcacattgcaccagaatttaaggacttaagacaacaaacattatcttacagtttctgtgggttagaaatctgggtgcagcttagctgggtgcctgtggctcataaaagaggtggtagtcaagctgtcagttggggttgcagtcacatctggaagctctactggtggaagatctgtttctgaactcattcatgtggctcttgcagggttcagtttcctggggctcttggactgaagaaatcaattgttgctggctgttggccagaggcttttctcagttctttgccatatgggcctctccaaagggcaccacagtttggcatctgcctccctctgagcaaatgagtgagagaaggtgacacctaagaatttttataacctaatcttggaagtggtatctcattatttctgctatattctatttgttagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagcttctctccaagataaaatggcaaacccaaaagagaaaactgcaatgtgtctggtaaatgagttagcccgtttcaatagagtccaaccccagtataaacttctgaatgaaagagggcctgctcattcaaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctgttgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaac

SEQ ID NO: 8908 - DNA, 3978 bp, Homo sapiens
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctgttgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaac

SEQ ID NO: 8909 - DNA, 4175 bp, Homo sapiens
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagtttttggagccgtgagggatacagcagtttggtcaatattgtcttaacatgcttcaaataaatcagcttctctccaagataaaatggcaaacccaaaagagaaaactgcaatgtgtctggtaaatgagttagcccgtttcaatagagtccaaccccagtataaacttctgaatgaaagagggcctgctcattcaaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctgttgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaac

SEQ ID NO: 8910 - DNA, 4380 bp, Homo sapiens
  misc_feature (3)..(3): n is a, c, g, or t
  misc_feature (196)..(196): n is a, c, g, or t
  misc_feature (222)..(222): n is a, c, g, or t
  misc_feature (244)..(244): n is a, c, g, or t
  misc_feature (302)..(302): n is a, c, g, or t
gantcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaanactctccaagaagcgcgctgcgaccnccgtcttacaggagcttaaaanacttccacctcttcctgtggtggaaaagccaaaactattttttaaaaaacgccctaanacataatccggctccttttcctttttggcctgttgaatttgcgggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctgttgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaac

SEQ ID NO: 8911 - DNA, 4044 bp, Homo sapiens
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctgttgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaac

SEQ ID NO: 8912 - DNA, 3963 bp, Homo sapiens
caaagtgtcattgtgtcataaacagcatgttttaaaattcagatttaataaactgatttaagacagtaaatttgaaagacaaaattaagtctcattcaggagtggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggtatgaattaaaagcaaaaacaaaaaacaaaacaattcattagcctcagattcttcatctgtatacatcacaaggctcattcttgcctgctagtatggcctacatgccacttacgttttaagttatttaggaacacaaaggacagacaaaaaagccatatgcacatgcctcattttctcttatttttgatctatctagtaattcttttgctgcctgtctcttctccattttccttcttcttttttaagcatttttcatattcttcactgtcttctatttggtcttgattaggtgcatctatctcttcgctctgtcttccacaaacaaaaattctgccttcagacatttggtgttagtatttcacactcagttctccctttttttacataaggattgagtttctttttatgatgattttacctttatagcaattttgaattttgcattctgttgctagtattgattcaggtacaccattaagatacaacattctagaagtctattaccttaggagttaattaaacatgatatttgaagaataatgaaatgctttatagttgtttgaggcataacaatgtgtatttgttttactggatcatgttttgaactgactagggagggtagcacctgcctcagatagtaccaacaattctgtttcactgggtagtctaaaactagcttatagtttaacttaacttgttgtgtatgtgaatttagggatggaaactttttttcccctatttattctttgtttccttctgggaaaaaaccccacaaaaatcagcactcctttatggatacattggagcttttgaaagaattgtaaactctaggaaggggaaatatctgtgtcttgatttcttagttgccttgaaaatcatgtactgaactgtaaccgctaacttgactggatgaactagtttgcttgtgtgtagagagtgtattgcttcctcagatttcactgttttcatctccttttccatcttagtctttattccttaagaccaaaaactgtaatatcctttagaaatgctctagaagatctgtattgtgtagaatgatcatgtatttataaatattttacaagtttagattataaaatgaaaaagaaggtcatgtgttttggggggtattttgcatgttcggatttttttttcccttcaccgaacccttctgattctttcaaactattgccaggtagttgttagtgtttctaattggactcttaatatgaacttcaagaagctgttaccagttatcggctctgtcatctgaaattttaaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaac

SEQ ID NO: 8913 - DNA, 3315 bp, Homo sapiens
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtatcattgcccagtgcctaagatcttttatgttcagctcactgtaggaaataatgaattttttggggaaggaaagactcgacaagctgctagacacaatgctgcaatgaaagccctccaagcactgcagaatgaacctattccagaaagatctcctcagaatggtgaatcaggaaaggatatggatgatgacaaagatgcaaataagtctgagatcagcttagtgtttgaaattgctctgaagcgaaatatgcctgtcagttttgaggttattaaagaaagtggaccaccacatatgaaaagctttgttactcgagtgtcagtaggagagttctctgcagaaggagaaggaaatagcaaaaaactctccaagaagcgcgctgcgaccaccgtcttacaggagcttaaaaaacttccacctcttcctgtggtggaaaagccaaaactattttttaaaaaacgccctaaaacaatagtaaaggccggaccagaatatggccaagggatgaaccctattagccgcctggcgcaaattcaacaggccaaaaaggaaaaggagccggattatgttttgctttcagaaagaggaatgcctcgacgtcgagaatttgtgatgcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtgaagcgctgttgttgttcttttgttctctcactctcatcttttaaatatcacctccgtgaaacccatccgaaaggccaccacccggcctagtcactgcccagcagtgggattagagaatggataggctgtacctgagaaactgcagagccgcctcctgggtgactcgggccgggttcctggccaacgtcatcgcattgttcaggctttctccttattgatttgcaaacattgtgcaatgagaaaacactacatggtctaactgctcgacccaacatgacaataggaatataattatgtaagatttcacaagcaaaaccaccacaaatcatgatctggctgactcacacgcgactggagaataaacaaacagcaacataaggaa

SEQ ID NO: 8914 - DNA, 2019 bp, Homo sapiens
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcaggtgaaggtaggcaatgaagttgctacaggaacaggacctaataaaaagatagccaaaaaaaatgctgcagaagcaatgctgttacaacttggttataaagcatccactaatcttcaggatcaacttgagaagacaggggaaaacaaaggatggagtggtccaaagcctgggtttcctgaaccaacaaataatactccaaaaggaattcttcatttgtctcctgatgtttatcaagagatggaagccagccgccacaaagtaatctctggcactactctaggctatttgtcacccaaagatatgaaccaaccttcaagctctttcttcagtatatctcccacatcgaatagttcagctacaattgccagggaactccttatgaatggaacatcttctacagctgaagccataggtttaaaaggaagttctcctactcccccttgttctccagtacaaccttcaaaacaactggaatatttagcaaggattcaaggctttcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtga

SEQ ID NO: 8915 - DNA, 1297 bp, Homo sapiens
tctgtattcagagcttggtttataccactttggttccaaatatatctggataaaatgctgatttcctcttttgagaatatacctgacaaggatcagattcatgtaacaagaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtga

SEQ ID NO: 8916 - DNA, 1255 bp, Homo sapiens
tctgacattagcccctgtgcagatgactttccatgctattggaagctccattgaagccagccatgatcaggcagccttaagtgccttgaaacaattttctgaacaaggactggatccaatcgatggagcaatgaatatcgaaaaaggttctcttgaaaaacaagccaagcatctgagagagaaagcggacaataaccaggcacccccgggctccatcgctcaggactgcaagaaatcaaactcggccgtctagcagctcccagaacccgcggctgccaccgcatccttataaacctgtcagcacgcatgagggtgtctgtgttcagggaaatgaatgactaataccattatttgagtcttatgtgaagacaacactattctaacacgagagataatatacatggtactgtttattcaactggggaaaaataaaactttgagcatttcccttggaactcgagatcagatcataactcatttgcctagaggcagcagaaatctgatcctgctactggagcttaaaataacaagtaaagaaaagtgttagaaacaaagctaaaattttaacatgattaataatagagaagttgggtttggttctgttgttatgattgttttgtcgtggtgcttgtgttcagttatattctctctctctctcatttcaaatactgcttgacaattcgaaaatgaaccaatgatgtgctgtggaatgtgatggttgtcttcatatagagtcacatggtttctctttttatgcagatatttataatcttcatcctatatcagtaggaataactataaggtgcactacaaaaagatgtatgcaaacaaacatgttttaaatcaggtcagatatctgatgaaaaatacgaactaatgttaagagcaagtagtttcaacatactccaggaactgagaaacaaaacaaagcaattgtgggttttgagctccatatactcttagcaagtaagggggcgtcttgcccctatatatcatcttcccggattccactccctgttgtgggaatcgcgcccacccccatccgtgtgttgtagccactcacggtttgcatcaagagtgttttttgtaactgcctctggacttgggacagtgagtaggatcaaaaataaataatgtacatgacggggaagggaaaaacctgttggagttgcttccagccagccacgctccgggccagcatgttggaatccagcgtggagcagatgcagtaaaaatgtggttggtttctgtgtga

SEQ ID NO: 8917 - DNA, 2718 bp, Homo sapiens
  misc_feature (1942)..(1942): n is a, c, g, or t
  misc_feature (1951)..(1951): n is a, c, g, or t
ccatgggaatattgaattatagagttggacaggatagtcttatttattgttgcatagcacattgcaccagaatttaaggacttaagacaacaaacattatcttacagtttctgtgggttagaaatctgggtgcagcttagctgggtgcctgtggctcataaaagaggtggtagtcaagctgtcagttggggttgcagtcacatctggaagctctactggtggaagatctgtttctgaactcattcatgtggctcttgcagggttcagtttcctggggctcttggactgaagaaatcaattgttgctggctgttggccagaggcttttctcagttctttgccatatgggcctctccaaagggcaccacagtttggcatctgcctccctctgagcaaatgagtgagagaaggtgacacctaagaatttttataacctaatcttggaagtggtatctcattatttctgctatattctatttgttagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagagatggcaacacttgaatggattacagggactctggagccaaagatccaaggagatgctcttttccttgtcagaacccagattaatcattagcttcttaaggcagggaatgaaaggtgaagtccaagaaacagatgaagagttacctaagtcagtgttataagatgttccatggtaaaagggatttgaagacaaattttggaaatgctgcatactgtatctctcttgaagactcctaaaggtgtcatgaagaaaactgtttacctaagtggttcctaacactgactgaacatcaggctttcctgggcagctttaaaaattctgatgcccagactttatgtggactaattaaatcagaatttctggttgcagaagcttgaaccgcactgttttttaaaacttccccaagtaattctatgtccagtcatttaaatactggtccccacaacccaaaacacattaccctctattaacatcaaagattatgagatggtttgaatagtcatagaacttttgaaagaagtaaagaagaagggaagaattacagttaaccacactccttaaggataattgttctggacagctagcttccccacattgctgagggttcacttttttttggaacctaaaactttacttagttcagtaattttggatagaaatatttctaaaagttatggcatatattttttatatccttaaatagaaaatgccacaattcttagcatgaagaatccttgctgttgactcattatcaaccttataaacaataagtattacaagcctcatgagatatgtacatggtttgtccttataccagataatcctagacatctgtttctagagtacccaagtgtgcttttagttactttccaaatcattgttgtcagtcagattgtcatcttatttcttgtttttgtcagtgcacctttgcatattgcttgctcctttctttgatgcttttcaattgctattatcttgaaaacngatattatngtttgaatttggggcaaagtaagagtagcagggctttaattacgccctaagatgtccccttaactgtggaaaacatcgagttttatctagttggtgaatttttttacttcagaatttatttttttctgtcataaattttgctaaggatctgcattttgagtagaatgaagtggccagatagttgaataatggtttggtgaatatctatatgtatatatgtatgtgtatgtgtgttacacatacatatttaatgacatgaagtactttggttgcttggaattggacagaaataacagtttttttttttttttgggacagagtcttgctctgtcacctaggctggagtgcaatggcgcgatctctgctcactgcaacttccacctcccaggttcaagtgattctcctgccgcagcctcccgagtagctgggattgcaggcgcctgccagcatgcccgccagcacgcctggctaatttttttttttgtatttttagtagagatggggtttcactatgttggccaggctggtcttggaactcctgatctcgtgatctgtgtgccttggcctcccaaagtgctgggattacaggcgtgagccaccgcgcctggccagaaataacagttttaataaatttcatgaaatcactttcttgtatgttaaaggaaacagaaagggttcatttgtgcatggtttagtctttcttttgaatgtggaagtttttcttcttatttgtgtgtctaaaaaaattaaaaagtgaaacattttcc

SEQ ID NO: 8918 - DNA, 1560 bp, Homo sapiens
ccatgggaatattgaattatagagttggacaggatagtcttatttattgttgcatagcacattgcaccagaatttaaggacttaagacaacaaacattatcttacagtttctgtgggttagaaatctgggtgcagcttagctgggtgcctgtggctcataaaagaggtggtagtcaagctgtcagttggggttgcagtcacatctggaagctctactggtggaagatctgtttctgaactcattcatgtggctcttgcagggttcagtttcctggggctcttggactgaagaaatcaattgttgctggctgttggccagaggcttttctcagttctttgccatatgggcctctccaaagggcaccacagtttggcatctgcctccctctgagcaaatgagtgagagaaggtgacacctaagaatttttataacctaatcttggaagtggtatctcattatttctgctatattctatttgttagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagaggtttgtatgtcttttttggttttgttcttaattattattttatccatgttataaaagtttctcacactcaaaagagtattttcattgtaaatctaattgaccttgggcattgtgcatggaatttagataaagcaggttcacaaggaatatttaaattaataacttaaagaaacccagttttcaggaactagttttttttttttttcccctaccccacaaacgtaaaagatctgaaggaactagtttttattgtgtcatgagggccctgtatttgttgcagggaagaccaagtcttaaagtcatttcacagtttatagtgttgactttctcattcatttaccaagcagagctcagtttttttcttgatttgtctaaatacattagtgaacatgaatgtttgtaatttatagggaaaaaagaaaaaatgtaaataatgtaatcccagaatttgccaccttttatattttcatgtactttacattctttttttctttgcatttaaatatatttaaccaagttgaagttgtcctttatatgcagtttttgtagtactttatgaaggtatgatagacatacagtaaaatgtacaaatcttaagtata

SEQ ID NO: 8919 - DNA, 1194 bp, Homo sapiens
ccatgggaatattgaattatagagttggacaggatagtcttatttattgttgcatagcacattgcaccagaatttaaggacttaagacaacaaacattatcttacagtttctgtgggttagaaatctgggtgcagcttagctgggtgcctgtggctcataaaagaggtggtagtcaagctgtcagttggggttgcagtcacatctggaagctctactggtggaagatctgtttctgaactcattcatgtggctcttgcagggttcagtttcctggggctcttggactgaagaaatcaattgttgctggctgttggccagaggcttttctcagttctttgccatatgggcctctccaaagggcaccacagtttggcatctgcctccctctgagcaaatgagtgagagaaggtgacacctaagaatttttataacctaatcttggaagtggtatctcattatttctgctatattctatttgttagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagagatgaagagttacctaagtcagtgttataagatgttccatggtaaaagggatttgaagacaaattttggaaatgctgcatactgtatctctcttgaagactcctaaaggtgtcatgaagaaaactgtttacctaagtggttcctaacactgactgaacatcaggctttcctgggcagctttaaaaattctgatgcccagactttatgtggactaattaaatcagaatttctggttgc

SEQ ID NO: 8920 - DNA, 2389 bp, Homo sapiens
  misc_feature (1613)..(1613): n is a, c, g, or t
  misc_feature (1622)..(1622): n is a, c, g, or t
agggagcgggggagcgccggggaggcgggcggaggcgggcggaggcggggggcggggagcccgaggggtggaagccggcggcggccgagcggggtcagttctctgtagtgtttgccaatgttggagccgtctgcaaagtgtccccggcaagaagaggctgcctaccacaaggactttagcttactttttaaagattgaagaaaaaaaagaagacagaaaaagaagaactcaaagatacacaaagtaatttgaaccaaggctcagaagtttttggagccgtgagggatacagcagtttggtcaatattgtcttaacatgcttcaaataaatcagcttctctccaagataaaatggcaaacccaaaagagaaaactgcaatgtgtctggtaaatgagttagcccgtttcaatagagtccaaccccagtataaacttctgaatgaaagagggcctgctcattcaaagatgttctcagtgcagctgagtcttggtgagcagacatgggaatccgaaggcagcagtataaagaaggctcagcaggctgttgccaataaagctttgactgaatctacgcttcccaaaccagttcagaagccacccaaaagtaatgttaacaataacccaggcagtataactccaactgtggaactgaatgggcttgctatgaaaaggggagagcctgccatctacaggccattagatccaaagccattcccaaattatagagctaattacaactttcggggcatgtacaatcagagatgaagagttacctaagtcagtgttataagatgttccatggtaaaagggatttgaagacaaattttggaaatgctgcatactgtatctctcttgaagactcctaaaggtgtcatgaagaaaactgtttacctaagtggttcctaacactgactgaacatcaggctttcctgggcagctttaaaaattctgatgcccagactttatgtggactaattaaatcagaatttctggttgcagaagcttgaaccgcactgttttttaaaacttccccaagtaattctatgtccagtcatttaaatactggtccccacaacccaaaacacattaccctctattaacatcaaagattatgagatggtttgaatagtcatagaacttttgaaagaagtaaagaagaagggaagaattacagttaaccacactccttaaggataattgttctggacagctagcttccccacattgctgagggttcacttttttttggaacctaaaactttacttagttcagtaattttggatagaaatatttctaaaagttatggcatatattttttatatccttaaatagaaaatgccacaattcttagcatgaagaatccttgctgttgactcattatcaaccttataaacaataagtattacaagcctcatgagatatgtacatggtttgtccttataccagataatcctagacatctgtttctagagtacccaagtgtgcttttagttactttccaaatcattgttgtcagtcagattgtcatcttatttcttgtttttgtcagtgcacctttgcatattgcttgctcctttctttgatgcttttcaattgctattatcttgaaaacngatattatngtttgaatttggggcaaagtaagagtagcagggctttaattacgccctaagatgtccccttaactgtggaaaacatcgagttttatctagttggtgaatttttttacttcagaatttatttttttctgtcataaattttgctaaggatctgcattttgagtagaatgaagtggccagatagttgaataatggtttggtgaatatctatatgtatatatgtatgtgtatgtgtgttacacatacatatttaatgacatgaagtactttggttgcttggaattggacagaaataacagtttttttttttttttgggacagagtcttgctctgtcacctaggctggagtgcaatggcgcgatctctgctcactgcaacttccacctcccaggttcaagtgattctcctgccgcagcctcccgagtagctgggattgcaggcgcctgccagcatgcccgccagcacgcctggctaatttttttttttgtatttttagtagagatggggtttcactatgttggccaggctggtcttggaactcctgatctcgtgatctgtgtgccttggcctcccaaagtgctgggattacaggcgtgagccaccgcgcctggccagaaataacagttttaataaatttcatgaaatcactttcttgtatgttaaaggaaacagaaagggttcatttgtgcatggtttagtctttcttttgaatgtggaagtttttcttcttatttgtgtgtctaaaaaaattaaaaagtgaaacattttcc

SEQ ID NO: 8921 - DNA, 176 bp, Homo sapiens
tttttttttttagaaagagagagggtttagattcctaaaggagtccgtatcccaaaagtcaagtctgaggtccaggtcctctctgaggctggtgaagataaaggaagaggtggaagaggaggaggaaaaggaggaggagaaatcttgaccagtccattacaaagataactggaaaa

SEQ ID NO: 8922 - DNA, 428 bp, Homo sapiens
acctcgtgatctgcccacctcggcctcccaaagtgctgggattacaggcgtgagccactgcaccaggctaattttttgtatttttagtagggatggggtttcaccgtgttagccaggatgggcttgaattagttttatctgtcataacacaaagcaaagtgttaggaagaagtcagtttttcagtagtataattgagctagagactttgcaaaaataaagggtttaggaaagggaactccatttatgaagcaactcaagccaggaattgtagcaagtattttccatgctatatattttatcagagaaatttcctggagaaatggcttgctgagtgtctgtagccagaaaatggcagagctgagatttgaaactaggtctttctgctagtgtctgttcctcgttaacattgtttccaagtacagacgcg

SEQ ID NO: 8923 - DNA, 3569 bp, Homo sapiens
agagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcacacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtgacactggttaactttttccagatctcatgtctggcttaataagagatatttgtattatcatatctgcctttgtattaaacctattggtatatcataggtcatgttagctcaaaaaaactttactgcacactactgagagaatgagatgaaaaacgattaatgtttcattattattattgtgaaaatattattaacactggggactccttaagagtacatcagagttctctctaggaatcccaaaaccacattttgaaactagaatagtggatcctggaagttaatccatgtgctggttaattttagatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaattct

SEQ ID NO: 8924 - DNA, 3221 bp, Homo sapiens
agagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcacacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtgacactggttaactttttccagatctcatgtctggcttaataagagatatttgtattatcatatctgcctttgtattaaacctattggtatatcataggtcatgttagctcaaaaaaactttactgcacactactgagagaatgagatgaaaaacgattaatgtttcattattattattgtgaaaatattattaacactggggactccttaagagtacatcagagttctctctaggaatcccaaaaccacattttgaaactagaatagtggatcctggaagttaatccatgtgctggttaattttagatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaattct

SEQ ID NO: 8925 - DNA, 2785 bp, Homo sapiens
  misc_feature (1167)..(1167): n is a, c, g, or t
agagaacaggtcccagataccgagtccgcaactccaaacatcgcgattaataggaggtgaacacagcttttctcttctctttgggatgctttgttgtctggtggtgactgtgcccatgggtgagttgtatcggaaaatcgtcatgtgaggatcagaggggaaaagaaaacagaaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaanactgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcacacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtg

SEQ ID NO: 8926 - DNA, 3508 bp, Homo sapiens
gcctcgcctggctttacctcgagtgtcccgacctgggtctcggggagggggaagtggagggacgagggtgtgaaagaatccagggacaactgaagaaaccggactgtggcccgagaagtgggaagaggaaggaggaaaacggcccccttgatctctgcattgatggcttacttatggaatgtttacggaatccctctttcggagatacctgagccttgagatgcaagcgactcccagaagttggggcaccgatgagacctacttgagtgacaggagaggttgggcccgaccagcactgaggtgccaagactcctaggctgattctcctcctctgtaaccctaggcctctggtctctgcctgccctgggtgctcatggaaccagctgctgctctgcacttctccctgccagcctccctcctcctcctcctgctcctcctccttctcagcctgtgtgcactggtctcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcacacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtgacactggttaactttttccagatctcatgtctggcttaataagagatatttgtattatcatatctgcctttgtattaaacctattggtatatcataggtcatgttagctcaaaaaaactttactgcacactactgagagaatgagatgaaaaacgattaatgtttcattattattattgtgaaaatattattaacactggggactccttaagagtacatcagagttctctctaggaatcccaaaaccacattttgaaactagaatagtggatcctggaagttaatccatgtgctggttaattttagatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaattct

SEQ ID NO: 8927 - DNA, 3632 bp, Homo sapiens
agagaacaggtcccagataccgagtccgcaactccaaacatcgcgattaataggaggtgaacacagcttttctcttctctttgggatgctttgttgtctggtggtgactgtgcccatgggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaagaacattcttacatgctgctgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcacacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtgacactggttaactttttccagatctcatgtctggcttaataagagatatttgtattatcatatctgcctttgtattaaacctattggtatatcataggtcatgttagctcaaaaaaactttactgcacactactgagagaatgagatgaaaaacgattaatgtttcattattattattgtgaaaatattattaacactggggactccttaagagtacatcagagttctctctaggaatcccaaaaccacattttgaaactagaatagtggatcctggaagttaatccatgtgctggttaattttagatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaattct

SEQ ID NO: 8928 - DNA, 2923 bp, Homo sapiens
  misc_feature (418)..(418): n is a, c, g, or t
agagaacaggtcccagataccgagtccgcaactccaaacatcgcgattaataggaggcctctggtctctgcctgccctgggtgctcatggaaccagctgctgctctgcacttctccctgccagcctccctcctcctcctcctgctcctcctccttctcagcctgtgtgcactggtctcagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaanactgatgtggtcctggatccagacaccgctcatcccgagctcttcctgtcagaggaccggagaagtgtgaggcggggcccctacaggcagagagtgcctgacaacccagagagattcgacagtcagccttgtgtcctgggatgggagagcttcgcctcagggaaacattactgggaggtggaggtggaaaacgtgatggtgtggactgtgggggtctgcagacacagtgttgagaggaaaggggaggtcctgctgattcctcagaatggcttctggaccctggagatgtttggaaaccaataccgggccctgtcctcccctgagaggattctccctttgaaggagtccctttgccgggtgggcgtcttcctggactatgaagctggagatgtctccttctacaacatgagggacagatcacacatctacacatgtccccgttcagcctttactgtgcctgtgaggcccttcttcaggttagggtctgatgacagccccatcttcatctgccctgcactcacaggagccagtggggtcatggtgcctgaagagggcctgaaacttcacagagtggggacccaccagagcctatagaatcaattccttggactcacagccatgcagataagccctggccatctcagcagccaccgcacaacccccctaatgaaagacacgccctcctcccctctggtcacgtaagagaacatcttccagctgcctttttcacacccactccagccctctgccccagttttctcctcctcactagtctgtggctttagtagttcctttgcttgtaattatgggatgggatccaggcatagggaactagttgtttcatagctcccagtcaaaaagaaagtgagagaagctgttgggcagcgaacctactgtttaaaatcaggataaccacattaagcccaatatgccagttggcaccagatgctgtggacttggaatgaggccaacagggttcaccaggatgagagaggagagaggaatccacaggaccaccagaagggagagggaaccagatatgcagatcagagatagaggaagtggaaccagagagctgggagggaccaaggttgtaaggatggctaagtcccaccataagagctaaagggtcctgggagatgatggctcatttccacccaaccccaggatttccacagcacacacccacaggcctggacctgggatgaagatgaatgaagaacatggactcatgtggatgtggtttggctcagatgtccctgcaataaacaaggggtcagtacttagtccctgagtgtggttgaggtttgaggtcctggtcgagcagggcagtactggaccaggtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtgacactggttaactttttccagatctcatgtctggcttaataagagatatttgtattatcatatctgcctttgtattaaacctattggtatatcataggtcatgttagctcaaaaaaactttactgcacactactgagagaatgagatgaaaaacgattaatgtttcattattattattgtgaaaatattattaacactggggactccttaagagtacatcagagttctctctaggaatcccaaaaccacattttgaaactagaatagtggatcctggaagttaatccatgtgctggttaattttagatgtcaacctgactggattaaggaatacctagacagctggtacaacattatttctgggtgtgtctgtgagtgtgtttccagaagagattggcaagtgagtcagtgggaaattctctccttctgttggctgggtgcccaatacaacaaaaaggcagaggaaaggcaaattcttctctcctctggagctgagacactcttcttcttctgcccttggacatcagaactcctggctctccggcctttgaacttcaggacttgtaccaggaggccctgggttctcaggcctttggctttggactgagagttacacaatcagcttccctggttctgaggctttcagacttaaactgagccatgctaccagcatcccagggtctccagcctacagatgagctgttgtgcgatttcttagcctccataatcacatgagccaatctccttaataaatgcctgctcatagatctgtatctacatctatatctgtatgtgcatctatatctatgcctatatctatatctatatcatattgattttgtctctctggagaaccctgactaataaaatgaggcatctaaaattct

SEQ ID NO: 8929 - DNA, 1443 bp, Homo sapiens
  misc_feature (1167)..(1167): n is a, c, g, or t
agagaacaggtcccagataccgagtccgcaactccaaacatcgcgattaataggaggtgaacacagcttttctcttctctttgggatgctttgttgtctggtggtgactgtgcccatgggtgagttgtatcggaaaatcgtcatgtgaggatcagaggggaaaagaaaacagaaggcctctggtctctgcctgccctgggtgctcatggaaccagctgctgctctgcacttctccctgccagcctccctcctcctcctcctgctcctcctccttctcagcctgtgtgcactggtctcagcccagtttactgtcgtggggccagctaatcccatcctggccatggtgggagaaaacactacattacgctgccatctgtcacccgagaaaaatgctgaggacatggaggtgcggtggttccggtctcagttctcccccgcagtgtttgtgtataagggtgggagagagagaacagaggagcagatggaggagtaccggggaagaatcacctttgtgagcaaagacatcaacaggggcagcgtggccctggtcatacataacgtcacagcccaggagaatgggatctaccgctgttacttccaagaaggcaggtcctacgatgaggccatcctacgcctcgtggtggcaggccttgggtctaagcccctcattgaaatcaaggcccaagaggatgggagcatctggctggagtgcatatctggagggtggtacccagagcccctcacagtgtggagggacccctacggtgaggttgtgcccgccctgaaggaggtttccatcgctgatgctgacggcctcttcatggtcaccacagctgtgatcatcagagacaagtatgtgaggaatgtgtcctgctctgtcaacaacaccctgctcggccaggagaaggaaactgtcatttttattccagaatcctttatgcccagcgcatctccctggatggtggccctagctgtcatcctgaccgcatctccctggatggtgtccatgactgtcatcctggctgttttcatcatcttcatggctgtcagcatctgttgcatcaagaaacttcaaagggaaaaaaagattctgtcaggggaaaagaaagttgaacaagaggaaaaagaaattgcacagcaacttcaagaagaattgcgatggagaanagtctacgtcagcattcaggttcaatggggacaccagtggcttcaaacttcctgatctaattatgtttttagacacttagaagttattgaggactttaaagagcttttgtttatttgggttaatatttatgacatttgacattgaaacaaaaatttaaaatgttatcttttaatttatgttaaaatagcattaataaatcagttataggttaatgtagataggatgttttgtgaaaaagcaatctattgtgtccaaataaaaaaacaaaaagtgtg

SEQ ID NO: 8930 - DNA, 791 bp, Homo sapiens
gaagagaggtggcatggtgggagggtacatttgagttgtcaacagtctctgcagtgtcaggtcaattacatcagcacttggactggaccagggaaaggaatgattctgcttcctgggaatgtcagaaggacctgatgattatatttggcaaagccaggaggagtggctttgaatgtcattgctaagaattacactttgagtagcatttctggatgtctgagcttttcaaatgatacttcttttctgctgtggctttcctttctgttggactggttcccagagggtcctcttgtttgtccttgccctcgcttttatatcagttcatgttttctcttctgtcatcttccttcccagcgctgtttctccaccccctcctgctgcactcacaacagcttcccctctcctgtttagaggtggaagcatgtaagaatgcgtttgagggggatgcttgccaaaggacagcatattcaacatctggtatcaacaaggtaatgtttaaccttagactagccaaactagtgatgacctgcttccatgctgcatctgctgctttttgtgttgatgggactcagaaatcatgagaaaggtcttcagtgatccatgactgcaacaaattcttttcctaattgtgccgtatattatgcccctcaatacaacttactaatctctgcctcagtttctccatctgtgaaagtggtgtaatacttatctacctcccttgaatgttgtgaagattagtatatgttggtaaagcacttttaaaataaagaatgatataaagcaaaaaaaag

SEQ ID NO: 8931 - DNA, 438 bp, Homo sapiens
gaagagaggtggcatggtgggagggtacatttgagttgtcaacagtctctgcagtgtcaggtcaattacatcagcacttggactggaccagggaaaggaatgattctgcttcctgggaatgtcagaaggacctgatgattatatttggcaaagccaggaggagtggctttgaatgtcattgctaagaattacactttgagtagcatttctggatgtctgagcttttcaaatgatacttcttttctgctgtggctttcctttctgttggactggttcccagagggtcctcttgtttgtccttgccctcgcttttatatcagttcatgttttctcttctcttgtttttttgttttttcttctgggggggggtctagaacagtgcctggcacatagtaggcgctcaataaaacttgtttgttgacatctcgtctcttctga

SEQ ID NO: 8932 - DNA, 408 bp, Homo sapiens
gcaggaagaaattgagaggcaacacagatttctattcctggaaatatggcagttaggttatttgaacaatcttcttgctgaaaaataattgaaactgttgagtatgtataagaaaacatcctcagagcagcaaagggctgaaaagagaaggaattaaaggctaaagtctgaaggcaagtgaaaattcagaaagaagtggagaactgaaactttttgcgcttaacgtagaattcagcacaatgatttggaggtggtgaggtcagggagtttctagggtgctcagaagtttctagttatagacctggtggtagctgtacgggataattattttctaaatttaaagtatgtattttgtgcacttttctatgtacatgttataatttacaacaaaggattaaatgtaaaagg

SEQ ID NO: 8933 - DNA, 447 bp, Homo sapiens
tctttcattcactcactcactctttcacaacacaaatgtctgtccagcacctactctgtgtcaggcaggaagtgcagggtgtggccctgaccttgatcaactcacaatctgggctcccacagctgcacacatgtgacaggccgaagttctgaagaggcacagggagcaaaatgtgtgaggctgagtagcgctgattccagctctgccacttggtagcaatgtggccttggactctgatcattggacaagccacctaggcaggacttggtgccactgtcttgctgccataagggcattccccactcaattcctggctcttcacactaaacaaagatactaccatcttaagtatcaattgcttcaactgcaaaatggagataaaatgcctaaaagtgactcctatgaaaactgaggctgtccgtgtgaagatcctggcacacagcaaat

SEQ ID NO: 8934 - DNA, 532 bp, Homo sapiens
agccaaggaatgtcaaagacggccagcacaccaccagaagctagcagagaggtatggaacagattcttcttcacaacctcagagggaaaaccctgctgatacctggatttcaaactcctggcctccagaacgaagtccctggagagaggacgtgatgtctgaagctatggcagccatcttgtaactatgaggccacaaacaagaaaagcaaaaaccagagtgaagcatggcagagcagaaagatggaaagaacctggatacataagagtgtcactgtgcagctgtacccaccctagactgcatatacctggactttaagtaaatgacaaatatcctttattctatctcaagccattgcttcttcatcttttttgtgtcatgacaatcacagtgggcggtaatatttgtactgccctctggggaacacagaggagactgctggcacctgaggtgaactatgctgggggcttcagctgccccaggactcctccctaccttgaagcctgaggggatacatatctctctgcacatc

SEQ ID NO: 8935 - DNA, 2769 bp, Homo sapiens
gtcaagatgagaagtctgtcaatgatgcttcctcagtttcagcatcccaaagaatttcttgtattcctaaaacccatatttctaataagtatgggaataatttcctccaggaagcacacatgagagaaaaatctttccaatgtaatgagagtggcaaagcctttaattgtagctcactgttaaaaaaatgtcagataatccatttaggagagaaaaaatataaatgtgatatatgtggcaaggtctttaatcagaagcgataccttgcataccatcatagatgtcacactggtgagaaaccttacaagtgtaatcagtgtggcaagaccttcagttacaagtcatcccttgtaattcacaaggcaattcatactggagagaaacctcacaagtgtaatgaatgtggcaaggtttttaatcaaaaagcatatcttgcaagtcatcatagacttcatactggagagaaaccttacaaatgtgaagaatgtgacaaagtttttagtcgctaatcacaccttgaaagacataggagaattcatactggagagaaaccgtacaaatgtaaggtttgtgacaaggctttcagacgtgattcacacctggcacaacatattgtaattcacactggagagaaaccttacaagtgtaatgagtgtggcaagacctttgttcaaaattcatctcttgtaatgcataaggtcattcatactggagagaaatgttacaagtgtaatgaatgtggcaaggtttttaatcacaaatcaaaccttgcatgtcatcatagacttcatactggagagaaaccttacaagtgtaatgaatgtggcaaggtttttaattgaaaatcaaaccttgaacatcatcatagagttcatatcggagaaaaaccttacaaatgtgaagaatgtgacaaagttttcaatttcaattcacgccttgaaatacataggagagttcatactggagagaaaccatagaaatgtaaggtttgtgacaaggcattcgggtgtgattcacacctggcacaacatactagaattcacactggagagaaaccgtgcaagtgtgatgagtgtgacagagccttcagtggtcagtcaacacttattcaccatcaagcaatccatgtcatagggaaactttactaatgtaatgattgtcacaaagtcctcagtaatgctacaaccattgcaaattattggagaatgcataatgaagtgagaacttacaagtgttataaatgtggcaaatttttcagacttcgttcataccttgcagtttatcagcgaactcatactggagagaaaccttacaaatgtgatgattgtggcaaggtcttcagtcaagcttcatcttatgcaaaacacaggtgaattcatacaagaaagaaacctcacaagggtgatgattgtgtcaaagcctttatttcaggttcatgcctcattacacatcagagaatccatactagacagagatcttacaaaagtcatatgtgtggcaagatctttagtctgaggtcactccttgcaggacatcaggaaattcatttttgaggtaataatttcaaatgcaatgagtatagcaaaccatcaagcacaattgatgttagattcaaatcagcattgagttcagtttgagttgacttaacattgagttcaagtatttgttgagattaaagtgtttatgttaagaggattaggccaggtgcggtggctcacacctgtaatcccagcactttgggaggccaagacaggtagatcacttgagatcaggagtttgagagcagcctggccaacagaggtgagcacctttcccagtctgttttttgtttcttcaacaaaaactgatagagatttttatgggtattgtgttgaatcaaaatcacattgggttatgtaatcatttaacagtattaatttttccaaaacatcaatatgggttatatctttatatatgtttttaatcattttgatcaatgtttgtagatttcaatgtatgaatttctcacttctttccatttattcctatttcttactttaagttctctagcaaatggaagtgtttttaaattttcatttaaaattgtttattgttaatgtatgaaaattcaacgaatttttggtgctgatattgtattgtgcaaatctactgatgtgtttattagtcacagtagtattttggttgactctttgtgattttctacacagaagatcatgtcatctacaaaaaatataattttactttttctgattttgaggcatttcatttcttttgctagttcattgctctggctaggacttccagtatttattgaatagaaaaagtgagaacgttcttgcatcatgtgagatcctacgggaaaaggattctattttccctgcttggttatctccacattggtcatttcatcaatggtctttctattggtgaggtaaatttccttctccatctattttgtttaagatttctatgatgatcagatgctgaattttgtgaaatgatttttctccatctgttgagatgatgtggttttcatctttcattctgttcaagtggtatatcacattgatttgcttgaatatgttgaaccatccttgcatgccagaagtaaatggcacttgcatatctacaatccttttatatatcctcttgaatacagttttctagtacaagtggtcttcaagaagctcatggaaaaatacatattatggaaaaattgtgcatgaatttcacagtttttgcaccaaaataaactgatacaaatctgtt

SEQ ID NO: 8936 - DNA, 540 bp, Homo sapiens
caggagtttgtgattacagtgagttatgatcgcagaactgcgctccagccttggtgacaaagagagaccctgtctctaaaaaaacgaaaaaaggaaaaacaatggccattgttttttgtaactttggcatcaaaaaccaaataccacatgttctcatttataagtggaagctaagctataggtatgtaaaggcataaagagtgctataatggacattggagactcagaagttgggaaagtgagaggggagtgagggatgaaaaactccctattgaatacaatatacactactcaggtaatgagtgcactaaaaccccagacatcaccactacataattcatccatgtaaccaaaaaccacttgtatctctaaaggtattggaataaaaaaatttaaataaccctgaggtatgttttctacggggaaagcaagataagtgattttctccccttatttattagatttcagaataatgaattggtggtttttcatctaccaaagactggccatgaagtgttttctcactccaccagatttaaa

SEQ ID NO: 8937 - DNA, 453 bp, Homo sapiens
tgtgtgtacgtattgttgtggactgaatatttgtgtcctctcaaaattcatatcttgaaatcctaactcctaaagtgatagtgtaggaaatgaaggctttgagaggcacttatgtaaggaaggtagcactaccatgaatggggttagtgccctaataaaaaaaagaccccagagagcactttagctgtctttctcccatggaaggacaaaacaagaagttgacattctgcaatatgaaagagggtcctcaccagagcccagccaagctggaaccctgatctcagacccccagcctctagaactatgaaaaattaatttctgtttttcatgaaccacccagtctatggtacctgtgatagcagcacaaactaagatacataatattcatatcatgtatacacatcttcaaaatacttcatgtcatgaaagttacttctatgttttaaacaaatt

SEQ ID NO: 8938 - DNA, 437 bp, Homo sapiens
taaatatagagttatttgacctagttctatgacccagcagttccactcctagttatatatccaaaagaattgaaaatatgttcacataaaaatgtgtacttgtgtgttcttagtagtattatggataatagccaaaaagtagaaataatcgggccaggcgcagtggctcacgcctgtaatcccagcactttgggaggccgaggcaggtggatcatgaggtcaggagatcgagaccatcctggctaacacggtgaaaccccgtctctactaaaaaaatacaaaaaaatttagctgggtgcggtgacgggtgcctgtagtcccagctactcaggaggctgaggcaggagaatggcgtgaaccctggaggcggagtttgcagtgagccgagatcatgccactgcagtccagcctgggagacagagtaagactccatctca

SEQ ID NO: 8939 - DNA, 552 bp, Homo sapiens
aatctctaggcaaaagtggcactggccactaaagagagcccacaggagctcaaactctaagggaggaaaacctttctccccactctggagctatagggccaagagggtgcatccaaacccagttatttttcctttctctctgtcctcccagagtttaccttgggatgaaggggcaattggagaagtccacaccaaagtgaagtaacaaaagacccacctttctagccagaggacaaaaaagaaaagcagcaggaaactgaaaatcaatggcacataaagattacgaagaaaaaaaactaaattgtccgtactcacagataacgtaattatccatgctgaatataccaaggaatctcaaaaaaaaaaaaaaaaacctacaacaaataagtgagtttgacaagcttgtacaatatagggtcaatatcaatatcataaatatcaacaatacttctataaactggaaataaacaatttaaaaccaaaaaattctaaaatcatttataacagctcaaaaaatatgaaataattgatatgaatctaacaaaacataca

SEQ ID NO: 8940 - DNA, 696 bp, Homo sapiens
ttcatttgacaaatgtaatttatatgcaccattattttatctcaagtagaaccctagacaagatgtttaaaaaaagaaccagtaaaggtattctaccacttaacagatgttgccctggctagattccctcactctaaaatggaagtgctaagaagtagctttcttcatttgtaatatctccttcagatttcataggctaagtgcattgtcttaaattagctacatagccaaaacagaagacaaattaaggctgatttcaggatgctaatcagaattaaactaggatatttgtgtaaacaggaaataggcttgaaatagacctatttcattttttactgaacctgcatttgtcttcaactagtagatgaggaaccagtatctagtttacagttaatggcatgctgctatcagttttgttttttaatacaaataagttacatgaaaagtaactacagcatgatccaaagatctatcttgacttggccttaagctttgagaatgcaatgcattccctccacattttccctgtatttcctaaatttttaaaaaggtaacagctttagacccagcttttagttgttactatcttgctttataaatgtaaacaaagactactgctgtcattggcctactgaatagcctccatagtcaacaagacactagatagttcaatggacttgtgcatactctgttttc

SEQ ID NO: 8941 - DNA, 1225 bp, Homo sapiens
catggtggcaggcacctgtagccccagctactcggaaggctgaggcaggagaatggcgtgaacccaggaggcagagcttgcagtgagccgagatcacacaactgcactccggcctgggcaacagagtgagactccatctcaaaacaaaaaaaagaaaaaagaaaaaacatacaatttatgaaaatgaaatgaaattacagtctttatgaaccacaaatacagtttttcagatatatcatggtttatatgttatatataaaactcttaactaaatctcaaacaagggaaaagtcacattaattactccaagagaaagaactggttactaactactttaatgcaggagctcgtggataaaaaagatgagtggataaaaaagcaagtgagtattcacaacagcatgacaaacaacacaggtatactcacatatatggcatttgataatcagagacagcactttagctgcctttcttcactgcctagagaaatgggcagcaatcaaggcattcaaaggtctacctcctttccttcttccaaccataaaaccaacctaactcaaaagaaaggtattttaaatctttatagataaaaatgaatagagtgacaaaatacatcatttgttttttctttattcattatcaagatggtggctatgaagaactaaatgaatcaggtttgtaaagttaacagatgctaataatgtcatattgtgatgcaaagatgagtgcttttatcctcagttcccttgataattgtgttatcaaacacatattgtgttcaatgttttagtgtgcttaagtacacttaagagcaacgttaatatctaatatcagccaccaagataaaaggctaaaactcctgtcaaaactactacacatactgaaaattcttttccctcctgttttcatctatttgaatataatttgtaataaaaatccatggccaggcacaatggttcacaactgtaatcccagcactttggaaggccaaggcaagaggattgcttgaactcaggagttcaagaacagcctgggcaacatggcaaaaccctgtctctacaaaaatatacaaaaattagctgggcatggtggcgtgtgactgtagttccagctactcagggggatgaggcgggattgctttgcacccaggaggtcaaggcttcagtgagccatgatggcaccactgcactccagcgtgggcaacagagagagagactgcctcattc

SEQ ID NO: 8942 - DNA, 837 bp, Homo sapiens
catggtggcaggcacctgtagccccagctactcggaaggctgaggcaggagaatggcgtgaacccaggaggcagagcttgcagtgagccgagatcacacaactgcactccggcctgggcaacagagtgagactccatctcaaaacaaaaaaaagaaaaaagaaaaaacatacaatttatgaaaatgaaatgaaattacagtctttatgaaccacaaatacagtttttcagatatatcatggtttatatgttatatataaaactcttaactaaatctcaaacaagggaaaagtcacattaattactccaagagaaagaactggttactaactactttaatgcaggagctcgtggataaaaaagatgagtggataaaaaagcaagtgagtattcacaacagcatgacaaacaacacaggtatactcacatatatggcatttgataatcagagacagcactttagctgcctttcttcactgcctagagaaatgggcagcaatcaaggcattcaaaggtctacctcctttccttcttccaaccataaaaccaacctaactcaaaagaaaggtattttaaatctttatagataaaaatgaatagagtgacaaaatacatcatttgttttttctttattcattatcaagatggtggctatgaagaactaaatgaatcaggtttgtaaagttaacagatgctaataatgtcatattgtgatgcaaagatgagtgcttttatcctcagttcccttgataattgtgttatcaaaccctttgggtccctgtttcggggttagtcattaaaccacgtaatttatatgccccagaaaggaaacgtgcat

SEQ ID NO: 8943 - DNA, 397 bp, Homo sapiens
gtaggttctcatatgcatacttatgatctcatggttacgaggcatttgatgttcctcctccagctcacattcctatcccaggcaggcaggaagagcaaaggggtctatatctggaaaacataagctctcccagaagccctctgcctgtgtcacatgactttccttagctacacaggagtccaggaaaatttttttttttggcttttctaaacactcctcctctgaacaaaattacacttctgttactgaggaagctgggagaattgatatcagagaagcaactagcagtacctgttatgtgggatttccagcactcacaaatggttgctgaccttttaccttcctgggaaaaaacagaaaaactaaaacagcaacccagagttctttaaaaaaaaaa

SEQ ID NO: 8944 - DNA, 373 bp, Homo sapiens
acaggcatttatgtgaccagcaatagctctgtgctatggagaaaagagaaaaggaattttgctgggacagctttcggtctctgctaaatttattgattgattttcaaattttttttagatatgaggtcttgctttgttgcccaggtaggtcttgaactcctgggctcaagcgattcccccaccttggcctcccaaagtgggattacaggcatgagctaccatgcccagctgctactaaatttattacccgtaaaataaaaataaaaataaatttaaaaaggaagttgagttttgattcgatgtcttcagagggcatttccttttggaattaatcatacagaagatgtatactctgaagcaatttgaagattta

SEQ ID NO: 8945 - DNA, 1279 bp, Homo sapiens
aacattaatttcatttttgtaccttatttttcccacttgatcaaaatggcactacagtaacacctatccttctgtgctgaggcagagaggtattgccacgtaagttgctctgcctaccagggctgtaagaaccatcccgggccaaaagcagagtgtcttccttcactggctatggtcagcactgagtggggcaagctggggccacatgcactattatccctcagcccgtgcctctcccaggtagtatgaatggaaagaagatccagaaggaagctcagcatacagccatgccttcctgctctgtctcggcccacccagtcaaagatgcaagcttgtcccttgctttctcctttctctcctcttggtgaggtgtggcccaatccttggagcttcgctgttgtctccaccggtgcacatctctccactggctccacatctctctccaaagaatgcagagccactaatcctacctggaacttcccagccagacaagaaaggctgcttcctggtctggtgtttggcctttcccaaacacccccttccttgggatcctgaccatgaaaacccaccatggacaaggacacaccctattctctccccagaaggtcacctgctgaacatcactaccacggatctgcctcatcaggagaaaggggactttggccatgtggcctcgccactcatgttaggacttctacagcaagccccatgccatgcataagtgtcttacagatggacttttagcacaacccacctatgcatggggaacgcagtaaaagaggcagcgaagagccagcctgtgcaaagctttgaatgactgtagggtcacaccaagacaacaacagaacaaagaatccaacgtttataacaaacttgcttaactcttactgacgctgaatgttacattattaaggataatttcagactcataactaggcaatcatcactctttttgtaaatcccatatttagatggcaaataaacagccaaaagttaaggcattcaaagggcacttgaaaaccattcctttatgtgaaaactggggtgctgtgataaaaggtaactaggatcttagcagtgcaatctgcagaatcatttataccaccaaggctacgtaaggcacaccgctaagatatatcttcggtttattctttttcttatgagtactagagttaaataaaacactatctaaatactcggggcaatggtgttaacattattcttgttgaaactagttaccagaataaagaaaaaatatcaaaaaaactgacatgatttg

SEQ ID NO: 8946 - DNA, 308 bp, Homo sapiens
atcacagctggtggcccaagaaatcctttctatcccccaaaacctgcaggtttgtaacccctagacaacagtaacattttgttgttctgtctctcaggtgcaggggaaaggctttagtctgacttttaatctttactataggtgaaaaaaaaataggcctttcgactactcttctcaaaaggcaaatttatttactaagctgtatgtcttataacagggataggaaaaaattgatagacatataaggacaagattctgtttataaacggagttttttatattttcaataggttttccacctgtaacca

SEQ ID NO: 8947 - DNA, 513 bp, Homo sapiens
ctatcgtcccaggagaccgggcgatgagccaaggctgctgtgtatccaacctgacatctgcaggaaacccccccggaacctgcccatgcaccacaccacagagaaaccaggacacaggggctcagggccagtgggggcgcaaaggctgcagaccgggagcggggcaccctgacaggtgggcacagcgcagagggcctgagggcccctggagttccaggggaggcgggtttgcgccaagaggccatgctggccactcctcctcaggggatctggaaacccagaggcagcagtgaggcgtggccccaaatctgggctcttcttcttacaaacgtggggctttgggcaaacgccttcatcactttcattctttgagcgcctcgtgtggaaaggagagttactaacgcctgactcacagccacgtgaggattccaacgagcaaagtgcgtagcgcagtacctgacccacaggaagtgaggcacccaataaatattagctgacattagaccttacttt

SEQ ID NO: 8948 - DNA, 330 bp, Homo sapiens
ctatcgtcccaggagaccgggcgatgagccaaggctgctgtgtatccaacctgacatctgcaggaaacccccccggaacctgcccatgcaccacaccacagagaaaccaggacacaggggctcagggccagtgggggcgcaaaggctgcagaccgggagcggggcaccctgacagatgtaagtgctctgggcaacacttcaccacagccatctgccagccttgagtccagtgacaagagggaacaagatggtttacaagtcacccctattctctgcaaatccagtttattaaacttggagttcacaaagaataaacggttaattcctagc

SEQ ID NO: 8949 - DNA, 393 bp, Homo sapiens
gataagattcagtgtgatttaacctgaagtctatgtacctgttaatgcacattcatgaaatacaccccatgctttggagaatgccgtctaccagagctgcagccttggcatccagagtaactcaaggctaggagttgtgtctggaaccatccatatccttcagtctcttcctgaagctcgctcttccttcatgtccaaggaggatgtaatctcctttgtgtcctcccactcagcccagtgaaggaagtagagtttgggttctgctgcttcggttttgagcacaccctagcagacaggcctgggctgcccttccgggcactggactttgaatgtggaacacagggaggcagagctgagacggcacaggcagaagtggtctcagctcgtctctgc

SEQ ID NO: 8950 - DNA, 476 bp, Homo sapiens
ttttttttttgagacagagtctcgctctgtcacccaggctggagtacagtggcgtgatcccagctcactgaaacctccgcctcccgggttcaattgattctcccgcctgagcttcccaagtagttgggactacaggcgctcaccaccatgcctagctaatttttgtatttttagcagagacagggtttagccattgttggccaagctggtctcaaactcacgacctcaagtgatctgcctgcctgcctcggcttcccaaagtgttgggattacaggcgtgacccaccgcacccggccaataaataaatttctaagtggtaatatgactaaaactcaagccatcaaaagaatttagaaagcttcttggagttctttgtaatgcagcaaactgcagttatgcatgactacttcataaaaggtcatgtcctcagtttagtgtatctctgacattgatcatgaaagctcaagaggagcca

SEQ ID NO: 8951 - DNA, 1291 bp, Homo sapiens
caaaaataaaaatatgtcttgaaaaatgaaatagattttaactcttcatccagtgctatggcaagtttaactgcactggaggtggtattccttttctacttttattcctatttatgtatttatttttaatcatattctcactgtgctaaatacagtcttcccactaattgttgaatgaaaattaagggtgaaagtctgtgttgggaagtgtagctccggatggtggagaaccagtgcttcttaggagcccttccctttatggatagggccaggggtccctatcttacgtggcagtcctaagctactcttgagtgatagcagtcacaacattgggatttcccattcctctgaaagtacccacagctaaacactactcatttcccaatttcagtatttactgaaatcacttacctacaattctgttagaatattatgttgagttcggaagacatttctctgtttgcaaggacagttagttgctctctgtcatagcccgcagaagcttggctacagtgtaattcctctccttgttctcctacactctttgtatctcagtgactgggtgtaagatttcatgccaaatgcaaggaatagtggaaatacataccaactgcaaagaatagaaaaactttatcccaatatattatagaaagatcttcagttcaattatgtccagagtaatataatttggcaatgttaatgcttttaagatttgaacttgtcctcaaaccaaggagacaacaatagtgtaatactattggacttacaggattagttttaaagcaactttgaatagaagtgtttcagacataggacttctgccttgttgactagagtggatagttttctgtttaaatgcattggtcttttggctgtttgtaattcacttcagcttatagagaagttgatgaccttggatcatgctgggtatgattggtctttaaaaagcagtaatataccaccagcccaaggagaaaacattgttaaaatgaagagtggtggaaatagtgtgttgggaagaataaaaaatttagattggcacttattctaaagtgagctgtttttttcaagaatttactagcatttgctcgtagtatgatttctgacgccagtcatatatactgatgaggggaaggagttactgtgttattctgagttcttataaatgcatattattgaatttcattgcatgactatttgtcaagacttacctggttaggtctccaattaaaagatgtaccacctgtcatcttctaaattgtgttcctttcatttattgggaacagaatct

SEQ ID NO: 8952 - DNA, 434 bp, Homo sapiens
cacgagacatgcacagtcaagcccctcccggagcctgtgttcggaggtatgagatgaggcgaccacactgccctcgctaccagctgcaaagatggcctgtacaggtgacagacggtctgacggcctccacagactctgaaccagcaccaccaagtctcactgctgccctctctccctccacaccagccagcttagaatttctggctctttctcccctgggcctggcaaggccatcttggttggccttgcggcagttttctgcagctgcggggaggcagggtggggcaaggacccacatccaaggacctcaggcaagcatcttctcccccaaatctacgtcatcagtcacaaaacactaacctgaaaagaccttgcaacaacccagtttcatcagctcattctacagatgagggagtgaagctcagagagggaaa

SEQ ID NO: 8953 - DNA, 453 bp, Homo sapiens
catttgcctcgtgatattctattaccttgtgaagcacgtgatctctgtgacccacaccctattcgtacactccctccccttttgaaagtccctaataaaaacttgctggttttgcggcttgtggggcatcatggaaactaccgacatgtgatgtctccccccggatgcccagctttagaatttctctcttttgtactcagtccctttatttctcaaaccagccaacgcttagggaaaatagaaaagaacctatgtgaaatatcgggtgaattttgcccgatatctggctgaatttcccctgatatatcctggagcttaaatattgaaatatcaagttaattactattaaacattttataatagtatggaaatggggtatggaaatttaaaatatcagttaatgtagacacaaatatgttcatgtctcaataataaatattcataccaccatag

SEQ ID NO: 8954 - DNA, 406 bp, Homo sapiens
aaaaggaaaaccctcctatccgaaagtcagaaacacgttttccttttatttttttttccaaaaatgttaaaagtttctccttaatttaagtccataatcctacctagaagtatgtgtgtggtgtgaggtagggatcttctttgtacccaaattctaaaacttgtgaatggtcttttgtgagtttatttttattcttagtgattcctttcacactgaaagcatattcctcctagctctccagctgtttgtataccttaggatgttagtgtgtgctgccttggggtctgtccaataactttttcttttttttttcctaatagaaataggctctttctctgtcacccaggctagagtgcagtgatggcgccactgtccatgcaagatctgcccccagcacacacacttg

SEQ ID NO: 8955 - DNA, 316 bp, Homo sapiens
caaaagaacattatgccaagatcatgggatgtgataaatattaatttactgtgaaaagcataatttatgtaaaatatgtatttttataagtctgcatcaagcagagtactctgtgttaacagtcctaaacgcattgccacccagggtatcacattgtcaggagactcttgtttagtgatatatgttttcaatttatttgtcatatgtgccatctatttaaaatgttagtgatcttgaacttcatatttgaatttaaggtgacatttaaacctctgtaatctaaggactaaagctcaagtacatgaatgataacttt

SEQ ID NO: 8956 - DNA, 1151 bp, Homo sapiens
cttagtgtggttcacatatcaggagcttctccaatagccaggctatgaggcactaaaatgaggaaatatggtttccaaacttcgcaaatacttatagtccagccacaggggatatactgataaactcagctcaaatgtcacctcctcagagatgctttctcaaccacccttagttccatgaggactgcatcattgtttaggccactcctgtatccccagagcacagaacattgtctggctcatagtaggtgctcaaaagttttgttgaatgaatgaacaaataaacgtgtaaggaagtcaggcacagcacttgcccacaggaagcttataagatgagcggcatgccattgggagtttgaatgatatatggagatccaaacagggcatcagaggactgctcagaggagtcagggaattaagaaaaaattgggagccagtgagccaagatgtgttaaaagcaagtgatcaagcttagattgcagtgttagttaatagagcatatgtgtccctgcctgatgcattaccttccctgcagtagttagccttctgggaccctgaaaagcatgcagaaaggttgacagcttacaatcaataccatgttcactgatgcaggaagcaacattatcacatccaagatattgcccccacacccaggctgcagcactaaatattccccataacaaggcaaagggaagtgacaagagctattattctcaaccctcccacttggaaacaagaggtgagacaaaccttcccctagatgttcttagggaaaggcaagacccccaaagaaatctttcagagctgagcacatgcctaatacagcaagacagggatgggagaagattggcattttcatttgcctgggtgtccacaatattgcaggggaagctctgtgggcagctgggaaatacaacaataaattggagggggatgaacaatagggtcagtggggctgtgtgctgagtgaatgctggattttattctacatgcccaattcactccaataagataaacttgacttcctccagtgtggctttcttatttcagcttctctgactgtggcataattgaaagtcatatttcatctagaccattggttttcaactccaaatgcaggtggcttatgaagactcagcctgaatatataa

SEQ ID NO: 8957 - DNA, 603 bp, Homo sapiens
  misc_feature (534)..(534): n is a, c, g, or t
  misc_feature (539)..(539): n is a, c, g, or t
  misc_feature (547)..(547): n is a, c, g, or t
  misc_feature (549)..(549): n is a, c, g, or t
cttagtgtggttcacatatcaggagcttctccaatagccaggctatgaggcactaaaatgaggaaatatggtttccaaacttcgcaaatacttatagtccagccacaggggatatactgataaactcagctcaaatgtcacctcctcagagatgctttctcaaccacccttagttccatgaggactgcatcattgtttaggccactcctgtatccccagagcacagaacattgtctggctcatagtaggtgctcaaaagttttgttgaatgaatgaacaaataaacgtgtaaggaagtcaggcacagcacttgcccacaggaagcttataagatgagcggcatgccattgggagtttgaatgatatatggagatccaaacagggcatcagaggactgctcagaggagtcagggaattaagaaaaaattgggagccagtgagccaagatgtgttaaaagcaagtgatcaagcttagattgcagtgttagttaatagagcatatgtgtccctgcctgatgcattaccttccctganctgantttatcantntatccctgtggctggactataagtatttgcgaagtttggaaaccatatcctcat

SEQ ID NO: 8958 - DNA, 584 bp, Homo sapiens
acagcttctacaagaaatcatctagttattcacgacttgttttttgaatgaaaaacttcaacatgctgattttttttccaagtatttgaatcatatacacatattcttttaaaacttcaacagataatatggagggttttaaaaattttttatgttatcttttgaatactaaataactgcagcctttgccaagagatatgtgaaaggtgtctgtatttaaaccatttattcatctgaatgttttattttttttcatcaaaatgatttgtagggtttgagaggaagagaaaatagtagatcatccacctgtagattcttcttccctttccattctgcttctgattggctttgtgcttcttacgttcttggcctttgccagcatgtatgaaataaagatgttgtcataattgatactagtaggttttaaaaggccttctgaggagtgatacttttgtattttattaggaacacatctctattggggaggagtgttctctttccccttttcaaatctagaccaaataggatttatgactttaaccttctgcttttcttactgtataaatttatattttcagctgaaa

SEQ ID NO: 8959 - DNA, 399 bp, Homo sapiens
tgctgtttctcttgccctccccccagcccggatctttacgcaactgtggtgaagatgccataaattccataaataactgggccaaaagcagagggagatttgctgaaggaagggtactttttcagagaaatagttaccttaaatacagagcagtgaaatcttacaaataaatgtcgagtccaagagaaatgctaagagatagaaaaggtccgagagcttcaatatctgtcaaataggagagaaagaaaaagaaagaaagaaagaagtaactcctattatatttcagctctgagacaaagtttagattgaaagtgttccagatattgagcagagtggatgaagaaagctcaaatgtagacaccaagtggtaaaatttcagagcagcaaaaatgaagaaaa

SEQ ID NO: 8960 - DNA, 382 bp, Homo sapiens
taaaaataaaaaatttaatcatagtaaatttaaccgatgagattaaatatgtatacactaaatacaataagatgttaatgacagaaatttcagtagacacaaataaatggaaaaatattccattagaataactaatactgtcaaagtaccgtattatcataagtgatctatatattcaaagtgaaaattttagtgtcatttttcacagtaatagaaaacacaattttgaaacttaagtgtaaccttaaacaactttaacactgattggctgggcacggtggctcacgcctgtaatccccagcactttgggaggccgaggtgggcagatcacgaggtcagatagagaccatcctggccaacatggcgaaaccccatctctact

SEQ ID NO: 8961 - DNA, 907 bp, Homo sapiens
ggcacctctgcctgtcagcaccaaagaatccaaactttaccagataccagggcccatggacctttcctctttggcgagtttcaaaattgccactgtcattttgggacacaatcacaacttgtcacaatcagacatatcaacttgtggaaaagagaaaatcattttaatgcaatagaaaggtagactgaataagtaagaatacatgcagaaggtagaggtttgcagaatgctcagctcctggggcttttcctgtatgggagaagtaatcctggtagatgtcagactcatattgttaaagcaaaactggattgaagtatttcttccctaactttgcccacacatccctcaggcaccaggttttcttttgcacacatttattctccttctttatcctttgaagtgtgcccttgtcagccacttaaatcagttgtcacctattaaaacaacctataggaccaacgaagaggtccttcaccacctaggacagtgtgtaatgatagactcacttaattgatccattgagaggtatgtgggggaacaataggagataaagcttctgtgatggtttaagccaagttggaaagtttctaactaaagaaagtcccagagatcatatatcttgaatagaaaagggatcagatcttagaatgctgagaaaaactgggaaccattaattttggctcatttcctaaactctctggatttcatagagccacaattcttctcaacctgggggcactgcttctgtctctggagagatagaagtgcagcttccgtaattctcagggtatgagctgcctgggatcaggggaccttcatggaaacggccactacatggggaacccccttcagctttctgagacttctctggggaccaggaaccacacaatccccagggttcctgaga

SEQ ID NO: 8962 - DNA, 219 bp, Homo sapiens
ctcccgagtacctgggactacaggctaatttttgtattttcagtagagacggggtttcgccatgttggccagactagtcttgaactactgacctcaagtgatccacccacctcagcctcccaaagtgctaggattacaagcatgggccactgcatcctgcctgaactgttcattttaaaatggttaattgcatggtttgtgaatctcacctgaatttct

SEQ ID NO: 8963 - DNA, 514 bp, Homo sapiens
cctttttactcttggactcatttcgcttaatgagtactttgcattctcaaagataatttaggaaattttaagataagaaatgaatctattaagtagttattgccacagaattgctattctgccatattagtcacttctcaggcaaataaagggcgtgtacatattctgtacgtactgaataaaacctattatgtaagaaaataaataatgctgaaaatgtgatcttggggaattcatattttacctcaggtttgtttctgggtttaagatttgtgactctcaatatttgctagtgtaagtaacgtagtcaaattaggaaatcggattttcgtattttccctcgagtgaataggtataatgcatggatttggttatgagtcctgaattctctgttcaatctgttgaaattttaaatgcaaataaatacagataaaatctgacatacattggccactgtacctagcccttaactttttttgacagggtctcactttgtcacccactgcatgccagc

SEQ ID NO: 8964 - DNA, 449 bp, Homo sapiens
cataagggtgtgattgtatattcagccaagacactgtatctcccttatgccttttattttcctgacatagcatgctgctggatcaatgtgtgtattgttgctactctgcctatgccagaggtggtgactcactcacacatataaataattttagttgaatgtttttataggttgtgtattccttacttgaaaggcttgggaccagaagtgttgcagatttcagatatttttagattttggaatatttgcattatacttaccagttgagcatcccacaaacctgtttaatcatgggacagcataaaatattgcccagtggagaacaatgcacatatatacttagatacaatgtttgcgtgaattttttattgttgtttttgagaaaaaaaatcatggtaaatattactacttctgtgtttctgcatacataaactttgagttaaagcatt

SEQ ID NO: 8965 - DNA, 447 bp, Homo sapiens
gttatctgggtaacagatgataaaacccctacttaaggccaacagcagtagaagcaaaaaatatttgaaaaacttgagataggaaaaacaagtcttgattgaaagtgggcaatgaagaaattggaataaaaaagagtataaagagcagccagaagcttaagtgggtcaaacagagcaaagaaacactgacataaaataagtctggtttgggtatcagtgaaagtggtagaataaaggcctctgaaagtcctctcctccataaaagcaataagaacaagggcaacaattttcagaattaacttttttaaaaaactgtagacattaataaaagatttggggaaaattcagggaacatttaagaaaagcagctgaattttggtataaaaacctgatatgaacagtgcagtattaatttttcctattctcatcccttcatttccagctcca

SEQ ID NO: 8966 - DNA, 433 bp, Homo sapiens
aagcaaaaacatttgtcctatttttttaacctctttgttttagacttctttttttcatccattctttaaatttcacagtttctatttgtctgcagagagacaaacgaaacagcatgaagcacgtttttaccgtaggcctcactggcgattggaacagcctcaatagaaatccaaattctaaaacactggctgacttggaggatatgtgaatttttcagctcgggggctctgaagtcagattagcacagatttttgaacccaaatgccctaaaatgaaaagataggaaaataggattctagaattatttgggggaaagcgtgaaaaaggtcatcttttgtctatcttcctgccttgtgccccatccttagaagcttaataggggagaactgcaaacctcaatgaattcttcattaaaaaaaaaaaataaactcc

SEQ ID NO: 8967 - DNA, 3642 bp, Homo sapiens
agggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagcttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgc

SEQ ID NO: 8968 - DNA, 3960 bp, Homo sapiens
agggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagcttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaaaaaaaaaaaaaaaaaaaaagaaagaaaaaaaaagagtaaaaagaagggaagaaaaacaatagaaaaaaaaaaagaggggggggggcgacaatattagtactggggggaggaaccattaagctgcaacagcatttttgaaagagagcgccacatagggggactaaataaaagaggggcggtttaaaacatgacggtgacaaacttgttggtatttggaaacacattttgctgggtatgggcacccaagaagtgagccgggaaaaaacaggggtttgggacccattgtgacttttttttaaattgtgtgtagtatggc

SEQ ID NO: 8969 - DNA, 3873 bp, Homo sapiens
agggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaatgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagcttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaaaaaaaaaaaaaaaaaaaaagaaagaaaaaaaaagagtaaaaagaagggaagaaaaacaatagaaaaaaaaaaagaggggggggggcgacaatattagtactggggggaggaaccattaagctgcaacagcatttttgaaagagagcgccacatagggggactaaataaaagaggggcggtttaaaacatgacggtgacaaacttgttggtatttggaaacacattttgctgggtatgggcacccaagaagtgagccgggaaaaaacaggggtttgggacccattgtgacttttttttaaattgtgtgtagtatggc

SEQ ID NO: 8970 - DNA, 2930 bp, Homo sapiens
aaatcgtctaggtagcgaggcctgggtggtgcggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaagcccctgagcctggctgcaggagtgaagctgctggagatcctggctgagcatgtgcacatgtcctcaggcagcttcatcaacatcagtgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagcttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaaaaaaaaaaaaaaaaaaaaagaaagaaaaaaaaagagtaaaaagaagggaagaaaaacaatagaaaaaaaaaaagaggggggggggcgacaatattagtactggggggaggaaccattaagctgcaacagcatttttgaaagagagcgccacatagggggactaaataaaagaggggcggtttaaaacatgacggtgacaaacttgttggtatttggaaacacattttgctgggtatgggcacccaagaagtgagccgggaaaaaacaggggtttgggacccattgtgacttttttttaaattgtgtgtagtatggc

SEQ ID NO: 8971 - DNA, 3654 bp, Homo sapiens
agggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaatgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgaggtgaacctggtgtcggagcacatctggtgcgaggactttctggtgcggagcttctacctgaagaacgtgcagacccaggagacgcgcacgctcacgcagttccacttcctcagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagcttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaaaaaaaaaaaaaaaaaaaaagaaagaaaaaaaaagagtaaaaagaagggaagaaaaacaatagaaaaaaaaaaagaggggggggggcgacaatattagtactggggggaggaaccattaagctgcaacagcatttttgaaagagagcgccacatagggggactaaataaaagaggggcggtttaaaacatgacggtgacaaacttgttggtatttggaaacacattttgctgggtatgggcacccaagaagtgagccgggaaaaaacaggggtttgggacccattgtgacttttttttaaattgtgtgtagtatggc

SEQ ID NO: 8972 - DNA, 1888 bp, Homo sapiens
agggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaaaaaaaaaaaaaaaaaaaaagaaagaaaaaaaaagagtaaaaagaagggaagaaaaacaatagaaaaaaaaaaagaggggggggggcgacaatattagtactggggggaggaaccattaagctgcaacagcatttttgaaagagagcgccacatagggggactaaataaaagaggggcggtttaaaacatgacggtgacaaacttgttggtatttggaaacacattttgctgggtatgggcacccaagaagtgagccgggaaaaaacaggggtttgggacccattgtgacttttttttaaattgtgtgtagtatggc

SEQ ID NO: 8973 - DNA, 677 bp, Homo sapiens
agggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaagagtaagaggtggaaccctagagatgggctattcacatttggactctctggagaagcccagaggagccttctaagaagaagtcactggaaaaggccagcttccatcttcttaggaccagttcctctcactggcattgtctgagtgctacagagccaagaactctggaatcctcagccaggataatattccactcacccaattcctcattcaacaagtatttattgagtacttactatgtagcaggcatagttttaggtatttggaatgtatcgggaataaaacaaagatctctgct

SEQ ID NO: 8974 - DNA, 3760 bp, Homo sapiens
agggaggtggggagcggcaagccccgcctcagcccctctggcaggctcccgccagcgtcgctgcggctccggcccgggagcgagcgcccggagctcggaaagatgcggcgcccgcggcggcctgggggtctcgggggatccgggggtctccggctgctcctctgcctcctgctgctgagcagccgcccggggggctgcagcgccgttagtgcccacggctgtctatttgaccgcaggctctgctctcacctggaagtctgtattcaggatggcttgtttgggcagtgccaggtgggagtggggcaggcccggccccttttgcaagtcacctccccagttctccaacgcttacaaggtgtgctccgacaactcatgtcccaaggattgtcctggcacgatgacctcacccagtatgtgatctctcaggagatggagcgcatccccaggcttcgccccccagagccccgtccaagggacaggtctggcttggcacccaagagacctggtcctgctggagagctgcttttacaggacatccccactggctccgcccctgctgcccagcatcggcttccacaaccaccagtgggcaaaggtggagctggggccagctcctctctgtcccctctgcaggctgagctgctcccgcctctcttggagcacctgctgctgcccccacagcctccccacccttcactgagttacgaacctgccttgctgcagccctacctgttccaccagtttggctcccgtgatggctccagggtctcagagggctccccagggatggtcagtgtcggccccctgcccaaggctgaagcccctgccctcttcagcagaactgcctccaagggcatatttggggaccaccctggccactcctacggggaccttccagggccttcacctgcccagctttttcaagactctgggctgctctatctggcccaggagttgccagcacccagcagggccagggtgccaaggctgccagagcaagggagcagcagccgggcagaggactccccagagggctatgagaaggaaggactaggggatcgtggagagaagcctgcttccccagctgtgcagccagatgcggctctgcagaggctggccgctgtgctggcgggctatggggtagagctgcgtcagctgacccctgagcagctctccacactcctgaccctgctgcagctactgcccaagggtgcaggaagaaatccgggaggggttgtaaatgttggagctgatatcaagaaaacaatggaggggccggtggagggcagagacacagcagagcttccagcccgcacatcccccatgcctggacaccccactgccagccctacctccagtgaagtccagcaggtgccaagccctgtctcctctgagcctcccaaagctgccagaccccctgtgacacctgtcctgctagagaagaaaagcccactgggccagagccagcccacggtggcaggacagccctcagcccgcccagcagcagaggaatatggctacatcgtcactgatcagaatgtggtgggaccagccctcaccttccgcatccggcacaatgagcagaacctgtctttggctgatgtgacccaacaagcagggctggtgaagtctgaactggaagcacagacagggctccaaatcttgcagacaggagtgggacagagggaggaggcagctgcagtccttccccaaactgcgcacagcacctcacccatgcgctcagtgctgctcactctggtggccctggcaggtgtggctgggctgctggtggctctggctgtggctctgtgtgtgcggcagcatgcgcggcagcaagacaaggagcgcctggcagccctggggcctgagggggcccatggtgacactacctttgagtaccaggacctgtgccgccagcacatggccacgaagtccttgttcaaccgggcagagggtccaccggagccttcacgggtgagcagtgtgtcctcccagttcagcgacgcagcccaggccagccccagctcccacagcagcaccccgtcctggtgcgaggagccggcccaagccaacatggacatctccacgggacacatgattctggcatacatggaggatcacctgcggaaccgggaccgccttgccaaggagtggcaggccctctgtgcctaccaagcagagccaaacacctgtgccaccgcgcagggggagggcaacatcaaaaagaaccggcatcctgacttcctgccctatgaccatgcccgcataaaactgaaggtggagagcagcccttctcggagcgattacatcaacgccagccccattattgagcatgaccctcggatgccagcctacatagccacgcagggcccgctgtcccataccatcgcagacttctggcagatggtgtgggagagcggctgcaccgtcatcgtcatgctgaccccgctggtggaggatggtgtcaagcagtgtgaccgctactggccagatgagggtgcctccctctaccacgtatatgagctggccggcagagggcacaccggcctccacgcggcccctgctggacttccgcaggaaggtgaacaagtgctaccggggccgctcctgccccatcatcgtgcactgcagtgatggtgcggggaggaccggcacctacatcctcatcgacatggtcctgaaccgcatggcaaaaggagtgaaggagattgacatcgctgccaccctggagcatgtccgtgaccagcggcctggccttgtccgctctaaggaccagtttgaatttgccctgacagccgtggcggaggaagtgaatgccatcctcaaggccctgccccagtgagaccctggggccccttggcgggcagcccagcctctgtccctctttgcctgtgtgagcatctctgtgtacccactcctcactgccccaccagccacctcttgggcatgctcagcccttcctagaagagtcaggaagggaaagccagaaggggcacgcctgcccagcctcgcatgccagagcctggggcatcccagagcccagggcatcccatgggggtgctgcagccaggaggagaggaaaggacatgggtagcaattctacccagagcttctcctgcctacattccctggcctggctctcctgtagctctcctggggttctgggagttccctgaacatctgtgtgtgtccccctatgctccagtatggaagaatggggtggagggtcgccacacccggctccccctgcttctcagccccgggcctgcctctgactcacacttgggcgctctgccctccctggcctcacgcccagcctcctcccaccaccctcccaccatgcgctgctcaacctctctccttctggcgcaagagaacatttctagaaaaaactacttttgtaccagtgtgaataaagttagtgtgttgtctgtgcagctgcaaaaaaaaaaaaaaaaaaaaagaaagaaaaaaaaagagtaaaaagaagggaagaaaaacaatagaaaaaaaaaaagaggggggggggcgacaatattagtactggggggaggaaccattaagctgcaacagcatttttgaaagagagcgccacatagggggactaaataaaagaggggcggtttaaaacatgacggtgacaaacttgttggtatttggaaacacattttgctgggtatgggcacccaagaagtgagccgggaaaaaacaggggtttgggacccattgtgacttttttttaaattgtgtgtagtatggc

SEQ ID NO: 8975 - DNA, 542 bp, Homo sapiens
  misc_feature (125)..(125): n is a, c, g, or t
gcgcggtgccacgaagcactctggccttcgcgggcgccgctgtccagacgacgcaggcggggcgccgtggactctgtaaactctccgggccagaatcgtgtgccggtaaactagtcaggtcaggntcgtgtgattgtaaactagtcaggtcagggtcgtgtgattgtaaactagtcaggtcagggtcgtgtgattgtaaactagtcaggtcagggtcgtgtgattgtaaactagtcaggtcagggtcgtgtgattgtaaactagtcaggtcaggatcgtgtgattgtaaactagtcaggtcagggtcgtgtgattgtaaactagtcaggtcagggtcgtgtgattgtaaactagtcaggtcaggatcgtgtgattgtaaactagtcaggtcagggtcgtgtgattgtaaactagtcaggtcagggtcgtgtgattgtaaactagtcaggtcaggatcgtgtgattgtaaactagtcaggtcaggatcgtgtgattgtaaactagtcaggtcagggtcgtgtgattgtaaactagtaaggtca

SEQ ID NO: 8976 - DNA, 508 bp, Homo sapiens
tttggtaaagtgaatgtatgttttccgattctgtggtttgtatagtctcaaagaacatgtaaaagttacctagtcatttttgtttagttctactgggctggactgtgtcttccaaagttcatacgctgaagttctaacccctagtacctcagaataagactgtgtttaaagatagggtttttaaggaaataattaaattaaaattgggtaattcgggctggtcttgatagagtaggactggtgtccttttaagaagtcaaactttgaacaaagagtcaaacatagagggaaggccatgtgaagatgcggggagaagatggccacccacaggtctcagagaaaggcatagaaccagtgcttccttcatggccctcagaaggaacctaccctctgtcgccttgatcttagacttctagactttagaactatgaagaaatatatttgtgtcacttcagccaccctgtcagtggtgctttgtaatgacagccctagaaaacgaatacaccta

SEQ ID NO: 8977 - DNA, 433 bp, Homo sapiens
gaatcatgtagtaaatataattcattttttgaaaggttcagctatatcctcttccatttgtttattttaaatgatctaattgcaaacatgtcatcactcccttgatgtttacctccttgttatgcatttttagcaggctttattgtcacctgagattttttttttctttgacaggctggagtctagatgaaggaaaatgtgttagaagcaccttatccacagatggggacacttggtcattcagcacatgttgagcttaggcaggcatcagggtctggctgcttacctgcttttattcacacctgcctgtttaggtggcctgcactgaacttctagaatgagtccaacctgatcatttactgtctctgaaagaaattatgctaatagagaaaaacggccagttgggatcacttgctgagccaagtaacttctt

SEQ ID NO: 8978 - DNA, 379 bp, Homo sapiens
tcaaatgattctctaccctcagcatcccaagtagctggaactacaaacacacgccaccatgactggctagtttatttatttttctgtggagacaggctctcactatgttgcccaggctggtcctgaactcctggcctcaactgaccctcctgcctttgccttccaaagtgttagaattacaggcaaaagccagtgcacatggccattatttatcatctctctgcaggtcattccttgactatccttctgaggctggaatttccaattgctttttgaaattctcacaccattgccttttcattcatttattcatccactcaaaaatatttattgagtgctaccgaaacatgtttaaaactatctacttaaataaaataaa

SEQ ID NO: 8979 - DNA, 474 bp, Homo sapiens
gcattcaagcaagaaagcctgggccctttgcaccctgaagggcctaactgacagaaaatgaacaggagctccctggaaggggtcttcacttggacaagatgctgttacctaagaagcaactagtcaagtcatttctgcaggactcctggctgatgggtgctatcaagttccaacaggaaagcagacttttacaccacagacttttaagtgctattagaattaaacagaaggaggaggaagaaaggaacaagaaggagaagaaagacaaagagaaggagagcatatttcccagctatggcccttttcactactttaaaagcaaaaccatcaaagaatgggcacctttctatgggtatgacttttatccccttgtcctctagatttattgcttgcaccacgtagcttccaccataaaactcttctttccaatagactgctatctgaatatcaagagcaagactctccagtaacata

SEQ ID NO: 8980 - DNA, 482 bp, Homo sapiens
cagaatcaccagctcccttgctgttccttccccatccctgccatcaagacagagccatttgctgctgtccatccatgttatggctcaagggctcagacatggtatagggaagatgggagcagggaaagacatgaactgctgtgctgtgtgacaaggccaggggtgtcactgaggatgcaacaggaagcaggcaggcaggtgagagaagctggggaggcgggagatagagagttattctagcacagcagtgaatgaattcagtttgaatgaagcacagaagtaaatgtttggacagcggaaccaggtttcatgatctttgagttgtcctcataacatgttggaactaggtattgaaaagtctgaggtaatctgaagcttagaaaggcacaatctatcaagttaacttaaaggaaaggaaggtgttaacaaaattagaaagtgctgttttagaaacagccctagatattttccaaaaaagcctt

SEQ ID NO: 8981 - DNA, 2231 bp, Homo sapiens
cacgaggtctaactataaatcaaaacccagaagtaatcaagaaaacaactagcaattagactacatacaaaaattttaaaatcctttctgatgaaaatcaccgtaaacaaaagataaatgacaaacagggaaaacatttgcaactctgttccctcattcagctactatttattcaatgcctactatatgccagctactcttctaggtgtttgagacatcatagtgaacaaaacagagagttaattgccctaatatacaaagagtttctagaaatcagtttttagataatcaacagcaaatggtataaacagacagcttacagttaaggaaacaagaaacccaataccatgtgaaaaaattttcagccttgcttataaaaagtgacgaaacaagatgaaactacactgaaatacaaattttcacatatcagattagcagaaaccccaaaattgtattgctcacagtgctggtacaagtgtggagcatgggcagcctcatgtgttactggtaggtggtaatgacacatgaataaagatataataggctaaaaagtatgttgttttactaatagttaattacaatatcaaaggaagatacaatgctaagttggtactattgtagtagctatcagagtgcagtttaccaaacagcaatttatcctacacataaactgcagacctaaacaataatacatatacatagttattttttgcaccattgtttgcaaacaacctaaataccagtcacctctatggcattcctcctccaaaatttgtattccctcatctaaatcatgagaaaagacaaaaccaaactgaaaaaggacttctacaaaatacatcaccagccgtcttcaaaagcatcaaggtcatgaaaaacaaggcagaaaaactccagagtggaggagaccaaggaggagtaggttctggagaagacaaaggacacttgggcaatctaaagtctggagttcacttaacagtatcaacccaatgttaatttcttagtttgatgaatgcatcgtgattatataacattagaggaagctgggtgaaaggtctcaacctcagcaccactgacattgagggcagatcattcttggttgtggggactgtcctgtgcattgcaggatgtttaattgcatccctggcctcgactcactgagtgcctatagtaccacctccccaggtcatgacaaccaaaaatgtctccagacattctccactgtcaattgcaaactcaccccttgttgaacaccactgatagacactaatccctaatatcaactaaccaatgaaatgctgtacctcttgttgtatgagaagaagaaacagacatcttctcaagtctatgagaatggcttttaactaatcaacaccttgattaaccagtagaaggcatatttagtgatgattcgcttatgactgcctgtacctcaccgggacaaaattgtggtttgttagagagtctttagccacaaacagaataacaaccactggcttatattgcaaaaaggatatgggaaattctatagatattggaaagaaaaatatattataagaagtctaggccgggtgcggtggctcattcctgtaaccgcagcactttgggaggctgaggcaggcggatcacctgatgtcaggagttcaagaccagcctggccaacatggtgaaaccccgtctctactaaaaatacaaaaaattagctgggcgtggtggtgggcgcctgtaatcccagctacttgggaggctgaggcaggagaattgcttgaacccgggaggcggaggttgcagtgggccaagatcacgccattgcactacagcctgggcaacaagagcgaaactccatctcaaaaaaaaaaaaaaaaaaaaagtctatacctactctgatgccattatcttgagatgtcttagatatgaataaaaagtcattccactcattatgagaactgtctttagaagaaaattatactgaattataccataggaatatctctaggttttgaaaatcatatacccagagatgattccataaataaggaatcaggcaaaaaaccaaaggaattcattggtgagaggagagtgttagggatctcattcccctgcaactactggctgaccccaaccctgcattgcaaaacacttggccccctctgacctcaaaaagcatttggtgcttcctcattaagctctatttattgtctttactattcacccatctgcctcagtctggg

SEQ ID NO: 8982 - DNA, 1461 bp, Homo sapiens
cacgaggtctaactataaatcaaaacccagaagtaatcaagaaaacaactagcaattagactacatacaaaaattttaaaatcctttctgatgaaaatcaccgtaaacaaaagataaatgacaaacagggaaaacatttgcaactctgttccctcattcagctactatttattcaatgcctactatatgccagctactcttctaggtgtttgagacatcatagtgaacaaaacagagagttaattgccctaatatacaaagagtttctagaaatcagtttttagataatcaacagcaaatggtataaacagacagcttacagttaaggaaacaagaaacccaataccatgtgaaaaaattttcagccttgcttataaaaagtgacgaaacaagatgaaactacactgaaatacaaattttcacatatcagattagcagaaaccccaaaattgtattgctcacagtgctggtacaagtgtggagcatgggcagcctcatgtgttactggtaggtggtaatgacacatgaataaagatataataggctaaaaagtatgttgttttactaatagttaattacaatatcaaaggaagatacaatgctaagttggtactattgtagtagctatcagagtgcagtttaccaaacagcaatttatcctacacataaactgcagacctaaacaataatacatatacatagttattttttgcaccattgtttgcaaacaacctaaataccagtcacctctatggcattcctcctccaaaatttgtattccctcatctaaatcatgagaaaagacaaaaccaaactgaaaaaggacttctacaaaatacatcaccagccgtcttcaaaagcatcaaggtcatgaaaaacaaggcagaaaaactccagagtggaggagaccaaggaggagtaggttctggagaagacaaaggacacttgggcaatctaaagtctggagttcacttaacagtatcaacccaatgttaatttcttagtttgatgaatgcatcgtgattatataacattagaggaagctgggtgaaaggtctcaacctcagcaccactgacattgagggcagatcattcttggttgtggggactgtcctgtgcattgcaggatgtttaattgcatccctggcctcgactcactgagtgcctatagtaccacctccccaggtcatgacaaccaaaaatgtctccagacattctccactgtcaattgcaaactcaccccttgttgaacaccactgatagacactaatccctaatatcaactaaccaatgaaatgctgtacctcttgttgtatgagaagaagaaacagacatcttctcaagtctatgagaatggcttttaactaatcaacaccttgattaaccagtagaaggcatatttagtgatgattcgcttatgactgcctgtggttaaggcgggtatactctagagtcgccatc

SEQ ID NO: 8983 - DNA, 428 bp, Homo sapiens
tttcaatcccatctgaatagaatacagaacaagagaatggtacctaaacactaaagggtaaagtttacttccagcaaaaattgcatgaaataatgagagaagaaaattgtgcacataacaagcaagaatatgtacatcagccgggcacggtggctcacgcctgtaatcccagcactttgggaggccgaggtgggtggatcatgaggttaggagttcgagaccagcctggccaatatggtgaaacccccatctgtactaaaaatacaaaaattaggtgggcgtggtggcgcgcgccagtagtcccagctgctcaggaggctgaggcaggagaatcgtctgaacccaggaggaggaggttgcagtgagctgagatagcgccactgtactccagcctgggcgacagagtgagacttcgtctcaaaaaaaaa

SEQ ID NO: 8984 - DNA, 1270 bp, Homo sapiens
tatattagaaaaaatacttgtgaagaattctagatgaaataatattcaagagaaatcagatgttttttaatgtaccagaatttctattcaggaatatgaaaatattttaaggcaaggtgcggtggctcattcctgtaattccagcactttggtagaccaagacaggtggattgcttgagtctagaagagaccagcttgggcaacatggcaaaaccccatctctacaaaaaaaaccacataaattagccaagggtggtggttcacacccgtagtcccagctactgggcggcggcggaggggttgagggttaggggtcaggggagacctgaggcaggaggattgcatgaacctgggggaggtcgaggctgcagtgagctgagatcacaccactgcgctccagcttggggtgacagaatgagatcttgtctccaagattaaaaaaaaaagaggaaaagaaattatttttaaatactgcttagttgtgagttacactttgacatctgtgcttatgaaggcaggtagggatctgcaaaacaagtaatgtcagattgaaaatagcagcaccattttatatccagtgaaaagacttgtatgaaataagcctttattgatttgtttatagataaaattttttaaatattaagtatattataaaaatgcagtcattgttgtattttgcctgtattaatcctttcactcacattcactcattttttgcctcaacttattgtctaaaaagtaagattggtactctgattttttttatttttgcttttttaagtctgtttaatgtctaaggaacgtaactagttagaacagctacttatttggcaatctcaagttatgggaagcatagctgagaatcaagaaaaaagcaaaataataataaataaataattatataaaaggatagttgagtctcagcaaataactaaacctgtgctctaaaaccctaagcactttaagtagaaagtagcctctaagtccccactccatatctttttactctttacacacatacacgcacacacacgcacagacgtatacacacacacaaaactttgcctctcccccttctttagtgaaaataacatttgtacatggtggtagatgtagatagtacaaaagaatgttgagtgataaattcatgtgagacaattttaataaacatgtttccctgcctactccagatttgagtaacaagttaaaaggtggacaagcactttgataatagcaaatagggtcaactgaaacagcaacaacaacaaca

SEQ ID NO: 8985 - DNA, 452 bp, Homo sapiens
ggttaagtaacttactcaaaaccagagttggcaacaggtgataagagctaaaatttaaacaaaggtctgtctgatttcaagtgcaaattcctagccactgtatcatcctgcctgtggcctgctcctgagaggtagagatctgcataggtcttggccatacaaaaagacatctggttggttgtcttgggtgctttgatggttcatttgtttactgtctgtgtctgtcttctccctcagcacctaccatatgcatgacacatactcaacaaatatttattgaatgaggctggggacagtggctcatgcttataatcttaccgctttgggaggctgaggtgggtggatctcttgagcccaggaattcaagaccaacctgcgcaacatggtgaaacctcatctctacaaaaaaatgcaaaaatcagctgggcatggtagcttgtaccttagtcccc

SEQ ID NO: 8986 - DNA, 4070 bp, Homo sapiens
  misc_feature (52)..(52): n is a, c, g, or t
acggccattcagctggtgccaaaggcagagttagagtctgtgctgtgggccntggaagatgggaggaggggcttgaggtttgcaaaggactgggagttcctgaggaagggggaatctgcctcttgttgccatgggcagctgttgtaggagcaggagagaaaggagggtgggtggtctcgaaaagaatattgggcaaaacctagccaattggccttagctgggagaagtagtgactcctgcatccttttttaaggtttaggaacctgagttcagaaacacctctcatggaagctgtactagttgtgatttacttaattccttaagttccatgacctgaagttaaccccgttcttcctctgctctcaacccattgccccttgagataactgtacatgtcactctgatcatggtaacagcatccctattgcttctgccagctgtcatggcaatcgtgtttcccatcacctgggcggttcagagccagtcatgggctgctgaatttaatggagcatgtttccaggttcttcatggcaaactgtactcatgacttaggagtgagtgttacttccatgtgcctgtcagcttgtgagggggaatgtggaggaaggtgagaaatacagctcccacagttgtgctcttcctagaggaagctctcagaacgcagccctcacgggatttccttaggtcagaggagagcatcgcatctcacgtttttaggtttatcactgccatcccacttctgggatgggaggtagcaagggcttctgtattttcttgtgttcattctagcaacccagacatttccggatcagatcctgctggtctccactcactggaaagtctgccagatgccgatttgagagctgcctgtccctgctttcaggaggagcggggagaaaaactccaatggtctttaatggtttctgcagctggccatggccaattcatatgacattgtgagtttgctttcttatagagctgctctggggagaggtttgctattgagatgtaacagtggagctgttgggtcttcatgactcctttgcgtgtgttccatgggactctctttctgggttccccatgcttatagttgcctcgtgtcacaagacagatactaatgtcaggtttgtggcttcctgatggtttgggtggggccccagtgtcctggtaatttataggactgcctcatctgggagcattgccttcttccttagtcccacgtggagtgaccagtcttcctccttgtagctgaacagggaggaaacttgcaccattacctgactgtggaagggtggcccacaagatgagctgtgcaccataaacacagcccacctctgatttgtcatgtggtacctcttctttccttggcttccatggtagtattatcaactaagcaagattgtgatcccagaaattggcttagcatgtgagtgttgcctcgtgagagtacaagtaatataactcgccatcttgcaggaagtgccaccccaatatagagcctgaagttggaatctgttgagatccttgggtggctgatatacagcctgggatctttcttttttttgttccttttcaaccacccataattttaatattattttttagtgtgtgtgtgcctggctttgcgctagatattgtagaaaacaaaaaaggtaaaagacgtaatatgtggcctaagggagcttttaggtgactgctgcacatcaagcagaaaatcaaggactatctaaagacgtttatagtagataagatcagggtagaccagatggtctgggaaagttctgtgcctctgaggctttgggttgtagtcaatggcaggacagacagtgagatgaaaaacacatgagcaaaagcaaggaagcagaaatctgcatggcatgtactgaacagtgcacagccctgttagagcaacatggttaaagaatcctttccagtgcggttttctagatggaagcttcccagccaccaggcagacctgagtgccaaggggttatgatggtgaggtggagcccaaagcccaaaggagtcagcaaggctcctgcccattgccagggcctcactatggtcagctcaggccatgtgagggaggcagagcctctgcaccccctgtgttactggggtttcttctggagaactcatacattcaggtacaaaacaaaccaactgaggaggtgtgacccaacctcaccacccacctttctcctcctggggagtgtcgtgttgaactgtgtctgtgtcagtgcactggtcccagccctggccgcagcctagtcctttctctgtggagtgggctgcaaaacagcagcgcaagaggagacagtcttcgtcaggtgtgggtgtttggtgcctgcatgggtggccttgcacagagcagttaggggaagatgagggggaggcatggggctgggccagctctctgggatacagcctggtcagagagtaaatggagcagaggagcaggtgtggcagcacctgcccttcacctccctgaccaggcccgtccctccttcgccagtgctgtgcagagctcatttaaatgtattcctttctaggtctgggcgcggtggctcacgcctgtaatcccagcactttgggaggctgaggtgggtggatcatgaggtcgggagttcaagaccagcttggccaaacagtgaaaccctatctctactaaaatacaaaaattagctgggcatggtggcatgcgcctgtagtcccagctacttgggaggctgagacaggagaattgcttgaacccaggaggcggaggttgcactgagccgagattgcgccactgccctctagcctagacgacagagtgagactccatctcaaaaaaaataaataatttctttctggttgtattttcaagtcacaaattggaaaaggcttacatctagggacccactgttgattcctaagttgtgggtgggtgatatcagtggcctcagtgcctgcataaccctcacctgtttatgactgatctactgtaaccttcctcaggttgagagtgagctgctgtgagccagtgacaactactgctacaacttgctgttacttgaaattcgtgtgctatgttggtagcacaggagtaggcgggcgggggttttggtgtgggcactaggtaagtgggtggcaaccggctctttgggaccattggtgctgacctttgcctggtcacctgcctgtgcctaggccaagtgaatgttacatcttggaacctgagccatggaggtggcgccacctccctgaggagaaaggtgtggccaaaggaaactcctgcatggctcctgctccttccccttccctacatttcacttgggctaatgatgtaagccccccttgaggttggggatggtgtggagatagctgcagacacccctgtaacagacatccaggaagaattagggagtgggggtaattatagttcctaggtctaggggtgagaggtgggagtagaaccagaagtgccctggaatccagccgtgtcagccctcaccccagggcccccaggaaagcatggcctgcttgaagccctctgctccctgcagaaactggggcgaggaggagctttttccttcagttagatctttcccttccctgctgcctcgctcccttagctttggagccctaaagttagtggacaagacactgggataaagctctatggctgctggaaggaggtctgagtctgtgtgtgtgcatatgcatgcatgtgtgtgtgtgtgtgtgtcctcatttgcagaagtcttgctaccagttagggtgttaagagcatctccactgggcggagacctggcatttgttttccactgttaagagaatgacacaccccctgtcatgtaagggaggagctattgagttagacattttccctatgggaatcctcggtttggtttgtgggaaaggagggaatggataagtgatttttatctctaatcgtcaacacagctgttcttccactgaatttgtgctattgcatacatgtagccatctttcttttcactgcagcagtgtttatcagtagttcaaaatgatttatttgctcctggggagtaaaaccttttttatta

SEQ ID NO: 8987 - DNA, 532 bp, Homo sapiens
agcgtggcctggcttttgtcttcccatttagttttcctcttttacccttccttttgtgcttaatttattaaaatagttgctgtataatttattttcataaactataaaaaaatactaaatggttaaaatagacttgcaggccaatcttaaatggggtgggaggggtctgagggtgggatggggaaagggaaagaggttttgatataaacaaaacaaatgcactttgggtgtgttttggtatttttctggggatagagggggtggggttagggatgtccctgtagattagttccagaatggggtgtctgtatatactgtattaataggcatgtttgactctcgtaaagggacgttagtagctgctgcaggtcctgtttggaaaccccatgtacaattcccagttttttgtaagtgtcagtgcgagagacatttgactcttgtgtttgtatctcctttttatgattgctgtacctacccatgtctttttggggaggggtgaaaagagatttgaaataaaaatgtttagaaatta

SEQ ID NO: 8988 - DNA, 236 bp, Homo sapiens
  misc_feature (35)..(35): n is a, c, g, or t
  misc_feature (58)..(58): n is a, c, g, or t
  misc_feature (69)..(69): n is a, c, g, or t
cgtccctttacgagagtcaaacatgcctattaatncagtatatacagacaccccattntggaactaatntacagggacatccctaaccccatgtacaattcccagttttttgtaagtgtcagtgcgagagacatttgactcttgtgtttgtatctcctttttatgattgctgtacctacccatgtctttttggggaggggtgaaaagagatttgaaataaaaatgtttagaaatta

SEQ ID NO: 8989 - DNA, 5389 bp, Homo sapiens
  misc_feature (52)..(52): n is a, c, g, or t
acggccattcagctggtgccaaaggcagagttagagtctgtgctgtgggccntggaagatgggaggaggggcttgaggtttgcaaaggactgggagttcctgaggaagggggaatctgcctcttgttgccatgggcagctgttgtaggagcaggagagaaaggagggtgggtggtctcgaaaagaatattgggcaaaacctagccaattggccttagctgggagaagtagtgactcctgcatccttttttaaggtttaggaacctgagttcagaaacacctctcatggaagctgtactagttgtgatttacttaattccttaagttccatgacctgaagttaaccccgttcttcctctgctctcaacccattgccccttgagataactgtacatgtcactctgatcatggtaacagcatccctattgcttctgccagctgtcatggcaatcgtgtttcccatcacctgggcggttcagagccagtcatgggctgctgaatttaatggagcatgtttccaggttcttcatggcaaactgtactcatgacttaggagtgagtgttacttccatgtgcctgtcagcttgtgagggggaatgtggaggaaggtgagaaatacagctcccacagttgtgctcttcctagaggaagctctcagaacgcagccctcacgggatttccttaggtcagaggagagcatcgcatctcacgtttttaggtttatcactgccatcccacttctgggatgggaggtagcaagggcttctgtattttcttgtgttcattctagcaacccagacatttccggatcagatcctgctggtctccactcactggaaagtctgccagatgccgatttgagagctgcctgtccctgctttcaggaggagcggggagaaaaactccaatggtctttaatggtttctgcagctggccatggccaattcatatgacattgtgagtttgctttcttatagagctgctctggggagaggtttgctattgagatgtaacagtggagctgttgggtcttcatgactcctttgcgtgtgttccatgggactctctttctgggttccccatgcttatagttgcctcgtgtcacaagacagatactaatgtcaggtttgtggcttcctgatggtttgggtggggccccagtgtcctggtaatttataggactgcctcatctgggagcattgccttcttccttagtcccacgtggagtgaccagtcttcctccttgtagctgaacagggaggaaacttgcaccattacctgactgtggaagggtggcccacaagatgagctgtgcaccataaacacagcccacctctgatttgtcatgtggtacctcttctttccttggcttccatggtagtattatcaactaagcaagattgtgatcccagaaattggcttagcatgtgagtgttgcctcgtgagagtacaagtaatataactcgccatcttgcaggaagtgccaccccaatatagagcctgaagttggaatctgttgagatccttgggtggctgatatacagcctgggatctttcttttttttgttccttttcaaccacccataattttaatattattttttagtgtgtgtgtgcctggctttgcgctagatattgtagaaaacaaaaaaggtaaaagacgtaatatgtggcctaagggagcttttaggtgactgctgcacatcaagcagaaaatcaaggactatctaaagacgtttatagtagataagatcagggtagaccagatggtctgggaaagttctgtgcctctgaggctttgggttgtagtcaatggcaggacagacagtgagatgaaaaacacatgagcaaaagcaaggaagcagaaatctgcatggcatgtactgaacagtgcacagccctgttagagcaacatggttaaagaatcctttccagtgcggttttctagatggaagcttcccagccaccaggcagacctgagtgccaaggggttatgatggtgaggtggagcccaaagcccaaaggagtcagcaaggctcctgcccattgccagggcctcactatggtcagctcaggccatgtgagggaggcagagcctctgcaccccctgtgttactggggtttcttctggagaactcatacattcaggtacaaaacaaaccaactgaggaggtgtgacccaacctcaccacccacctttctcctcctggggagtgtcgtgttgaactgtgtctgtgtcagtgcactggtcccagccctggccgcagcctagtcctttctctgtggagtgggctgcaaaacagcagcgcaagaggagacagtcttcgtcaggtgtgggtgtttggtgcctgcatgggtggccttgcacagagcagttaggggaagatgagggggaggcatggggctgggccagctctctgggatacagcctggtcagagagtaaatggagcagaggagcaggtgtggcagcacctgcccttcacctccctgaccaggcccgtccctccttcgccagtgctgtgcagagctcatttaaatgtattcctttctaggtctgggcgcggtggctcacgcctgtaatcccagcactttgggaggctgaggtgggtggatcatgaggtcgggagttcaagaccagcttggccaaacagtgaaaccctatctctactaaaatacaaaaattagctgggcatggtggcatgcgcctgtagtcccagctacttgggaggctgagacaggagaattgcttgaacccaggaggcggaggttgcactgagccgagattgcgccactgccctctagcctagacgacagagtgagactccatctcaaaaaaaataaataatttctttctggttgtattttcaagtcacaaattggaaaaggcttacatctagggacccactgttgattcctaagttgtgggtgggtgatatcagtggcctcagtgcctgcataaccctcacctgtttatgactgatctactgtaaccttcctcaggttgagagtgagctgctgtgagccagtgacaactactgctacaacttgctgttacttgaaattcgtgtgctatgttggtagcacaggagtaggcgggcgggggttttggtgtgggcactaggtaagtgggtggcaaccggctctttgggaccattggtgctgacctttgcctggtcacctgcctgtgcctaggccaagtgaatgttacatcttggaacctgagccatggaggtggcgccacctccctgaggagaaaggtgtggccaaaggaaactcctgcatggctcctgctccttccccttccctacatttcacttgggctaatgatgtaagccccccttgaggttggggatggtgtggagatagctgcagacacccctgtaacagacatccaggaagaattagggagtgggggtaattatagttcctaggtctaggggtgagaggtgggagtagaaccagaagtgccctggaatccagccgtgtcagccctcaccccagggcccccaggaaagcatggcctgcttgaagccctctgctccctgcagaaactggggcgaggaggagctttttccttcagttagatctttcccttccctgctgcctcgctcccttagctttggagccctaaagttagtggacaagacactgggataaagctctatggctgctggaaggaggtctgagtctgtgtgtgtgcatatgcatgcatgtgtgtgtgtgtgtgtgtcctcatttgcagaagtcttgctaccagttagggtgttaagagcatctccactgggcggagacctggcatttgttttccactgttaagagaatgacacaccccctgtcatgtaagggaggagctattgagttagacattttccctatgggaatcctcggtttggtttgtgggaaaggagggaatggataagtgatttttatctctaatcgtcaacacagctgttcttccactgaatttgtgctattgcatacatgtagccatctttcttttcactgcagcagtgtttatcagtagttcaaaatgatttatttgctcctggggagtaaaaccttttttattaaaaaaagaaaaagaaaaaaaaaagaaagaaaagtgtgcccccctcctatgctgcgatagctataaaatgattgggtcacaaaggtcaagtctgcacgtccctgtggtagaccctgctttcacattggagccttcacactcagcacaaaatgattggaggccttgataaaatggagagcaaagtcttgggagcagtgaaatgggggttggatcatagagacaggcgctggggactcgggtactgcagttaggaaagtagcgttatgagttgtactgaaaatgttgattctctaatctgccagaaaaggacctgtcttttcatgcagatttcatattgtctttgtccttttcattgcttcttgaccttcctggcaggtgtcgctcagtttcttcctgtttcccttcctgtcctctccacacctgctatcccgtcccactcccatctacctcccgggaagccagccctgcatgctgagtttgtgacctgcttcattcccatttcatttctagagggtttagaggtgacctggaaccgttccctttccctctcctaccccctcctctgcaacaccaagaggcctggaggggcagacagaaagcagccagccacggcgggaagacatgcatgtttggttgcagctggactgcgatcgtagttcctcctggagatagagtgtgaggaacttaggacactcttcctcagactctgggatcatcacataccacactgccccgctcagagtttcgtcctgagctccctaaccagctcaggtggagcagaagcctgctctcactcctccatctctggtgctcccttgggcggggacctgtccctcactcttaggcccagaacctgtccaagggacaggtagggtccaggtgccactttgggtagctggctgttggaatgcccacactggtgctgcctgtggcatagccactgctgtacgtttttggttgtttttaagaaactcgatgaagaggttttgatataaacaaaacaaatgcactttgggtgtgttttggtatttttctggggatagagggggtggggttagggatgtccctgtagattagttccagaatggggtgtctgtatatactgtattaataggcatgtttgactctcgtaaagggacgttagtagctgctgcaggtcctgtttggaaaccccatgtacaattcccagttttttgtaagtgtcagtgcgagagacatttgactcttgtgtttgtatctcctttttatgattgctgtacctacccatgtctttttggggaggggtgaaaagagatttgaaataaaaatgtttagaaatta

SEQ ID NO: 8990 - DNA, 5380 bp, Homo sapiens
  misc_feature (52)..(52): n is a, c, g, or t
  misc_feature (5051)..(5051): n is a, c, g, or t
  misc_feature (5077)..(5077): n is a, c, g, or t
  misc_feature (5098)..(5098): n is a, c, g, or t
  misc_feature (5114)..(5115): n is a, c, g, or t
acggccattcagctggtgccaaaggcagagttagagtctgtgctgtgggccntggaagatgggaggaggggcttgaggtttgcaaaggactgggagttcctgaggaagggggaatctgcctcttgttgccatgggcagctgttgtaggagcaggagagaaaggagggtgggtggtctcgaaaagaatattgggcaaaacctagccaattggccttagctgggagaagtagtgactcctgcatccttttttaaggtttaggaacctgagttcagaaacacctctcatggaagctgtactagttgtgatttacttaattccttaagttccatgacctgaagttaaccccgttcttcctctgctctcaacccattgccccttgagataactgtacatgtcactctgatcatggtaacagcatccctattgcttctgccagctgtcatggcaatcgtgtttcccatcacctgggcggttcagagccagtcatgggctgctgaatttaatggagcatgtttccaggttcttcatggcaaactgtactcatgacttaggagtgagtgttacttccatgtgcctgtcagcttgtgagggggaatgtggaggaaggtgagaaatacagctcccacagttgtgctcttcctagaggaagctctcagaacgcagccctcacgggatttccttaggtcagaggagagcatcgcatctcacgtttttaggtttatcactgccatcccacttctgggatgggaggtagcaagggcttctgtattttcttgtgttcattctagcaacccagacatttccggatcagatcctgctggtctccactcactggaaagtctgccagatgccgatttgagagctgcctgtccctgctttcaggaggagcggggagaaaaactccaatggtctttaatggtttctgcagctggccatggccaattcatatgacattgtgagtttgctttcttatagagctgctctggggagaggtttgctattgagatgtaacagtggagctgttgggtcttcatgactcctttgcgtgtgttccatgggactctctttctgggttccccatgcttatagttgcctcgtgtcacaagacagatactaatgtcaggtttgtggcttcctgatggtttgggtggggccccagtgtcctggtaatttataggactgcctcatctgggagcattgccttcttccttagtcccacgtggagtgaccagtcttcctccttgtagctgaacagggaggaaacttgcaccattacctgactgtggaagggtggcccacaagatgagctgtgcaccataaacacagcccacctctgatttgtcatgtggtacctcttctttccttggcttccatggtagtattatcaactaagcaagattgtgatcccagaaattggcttagcatgtgagtgttgcctcgtgagagtacaagtaatataactcgccatcttgcaggaagtgccaccccaatatagagcctgaagttggaatctgttgagatccttgggtggctgatatacagcctgggatctttcttttttttgttccttttcaaccacccataattttaatattattttttagtgtgtgtgtgcctggctttgcgctagatattgtagaaaacaaaaaaggtaaaagacgtaatatgtggcctaagggagcttttaggtgactgctgcacatcaagcagaaaatcaaggactatctaaagacgtttatagtagataagatcagggtagaccagatggtctgggaaagttctgtgcctctgaggctttgggttgtagtcaatggcaggacagacagtgagatgaaaaacacatgagcaaaagcaaggaagcagaaatctgcatggcatgtactgaacagtgcacagccctgttagagcaacatggttaaagaatcctttccagtgcggttttctagatggaagcttcccagccaccaggcagacctgagtgccaaggggttatgatggtgaggtggagcccaaagcccaaaggagtcagcaaggctcctgcccattgccagggcctcactatggtcagctcaggccatgtgagggaggcagagcctctgcaccccctgtgttactggggtttcttctggagaactcatacattcaggtacaaaacaaaccaactgaggaggtgtgacccaacctcaccacccacctttctcctcctggggagtgtcgtgttgaactgtgtctgtgtcagtgcactggtcccagccctggccgcagcctagtcctttctctgtggagtgggctgcaaaacagcagcgcaagaggagacagtcttcgtcaggtgtgggtgtttggtgcctgcatgggtggccttgcacagagcagttaggggaagatgagggggaggcatggggctgggccagctctctgggatacagcctggtcagagagtaaatggagcagaggagcaggtgtggcagcacctgcccttcacctccctgaccaggcccgtccctccttcgccagtgctgtgcagagctcatttaaatgtattcctttctaggtctgggcgcggtggctcacgcctgtaatcccagcactttgggaggctgaggtgggtggatcatgaggtcgggagttcaagaccagcttggccaaacagtgaaaccctatctctactaaaatacaaaaattagctgggcatggtggcatgcgcctgtagtcccagctacttgggaggctgagacaggagaattgcttgaacccaggaggcggaggttgcactgagccgagattgcgccactgccctctagcctagacgacagagtgagactccatctcaaaaaaaataaataatttctttctggttgtattttcaagtcacaaattggaaaaggcttacatctagggacccactgttgattcctaagttgtgggtgggtgatatcagtggcctcagtgcctgcataaccctcacctgtttatgactgatctactgtaaccttcctcaggttgagagtgagctgctgtgagccagtgacaactactgctacaacttgctgttacttgaaattcgtgtgctatgttggtagcacaggagtaggcgggcgggggttttggtgtgggcactaggtaagtgggtggcaaccggctctttgggaccattggtgctgacctttgcctggtcacctgcctgtgcctaggccaagtgaatgttacatcttggaacctgagccatggaggtggcgccacctccctgaggagaaaggtgtggccaaaggaaactcctgcatggctcctgctccttccccttccctacatttcacttgggctaatgatgtaagccccccttgaggttggggatggtgtggagatagctgcagacacccctgtaacagacatccaggaagaattagggagtgggggtaattatagttcctaggtctaggggtgagaggtgggagtagaaccagaagtgccctggaatccagccgtgtcagccctcaccccagggcccccaggaaagcatggcctgcttgaagccctctgctccctgcagaaactggggcgaggaggagctttttccttcagttagatctttcccttccctgctgcctcgctcccttagctttggagccctaaagttagtggacaagacactgggataaagctctatggctgctggaaggaggtctgagtctgtgtgtgtgcatatgcatgcatgtgtgtgtgtgtgtgtgtcctcatttgcagaagtcttgctaccagttagggtgttaagagcatctccactgggcggagacctggcatttgttttccactgttaagagaatgacacaccccctgtcatgtaagggaggagctattgagttagacattttccctatgggaatcctcggtttggtttgtgggaaaggagggaatggataagtgatttttatctctaatcgtcaacacagctgttcttccactgaatttgtgctattgcatacatgtagccatctttcttttcactgcagcagtgtttatcagtagttcaaaatgatttatttgctcctggggagtaaaaccttttttattaaaaaaagaaaaagaaaaaaaaaagaaagaaaagtgtgcccccctcctatgctgcgatagctataaaatgattgggtcacaaaggtcaagtctgcacgtccctgtggtagaccctgctttcacattggagccttcacactcagcacaaaatgattggaggccttgataaaatggagagcaaagtcttgggagcagtgaaatgggggttggatcatagagacaggcgctggggactcgggtactgcagttaggaaagtagcgttatgagttgtactgaaaatgttgattctctaatctgccagaaaaggacctgtcttttcatgcagatttcatattgtctttgtccttttcattgcttcttgaccttcctggcaggtgtcgctcagtttcttcctgtttcccttcctgtcctctccacacctgctatcccgtcccactcccatctacctcccgggaagccagccctgcatgctgagtttgtgacctgcttcattcccatttcatttctagagggtttagaggtgacctggaaccgttccctttccctctcctaccccctcctctgcaacaccaagaggcctggaggggcagacagaaagcagccagccacggcgggaagacatgcatgtttggttgcagctggactgcgatcgtagttcctcctggagatagagtgtgaggaacttaggacactcttcctcagactctgggatcatcacataccacactgccccgctcagagtttcgtcctgagctccctaaccagctcaggtggagcagaagcctgctctcactcctccatctctggtgctcccttgggcggggacctgtccctcactcttaggcccagaacctgtccaagggacaggtagggtccaggtgccactttgggtagctggctgttggaatgcccacactggtgctgcctgtggcatagccactgctgtacgtttttggttgtttttaagaaactcgatgaagnaggggtgtcattctgggctcggggtnggttgccaatttttcaccagnaaagggagccaccccnnttgcaaccacttctgtctccgttagccccctgtcatgtaagggaggagctattgagttagacattttccctatgggaatcctcggtttggtttgtgggaaaggagggaatggataagtgatttttatctctaatcgtcaacacagctgttcttccactgaatttgtgctattgcaaacatgtagccatctttcttttcactgcagcagtgtttatcagtagttcaaaatgatttatttgctcctggggagtaaaaccttttttat

SEQ ID NO: 8991 - DNA, 4580 bp, Homo sapiens
  misc_feature (52)..(52): n is a, c, g, or t
acggccattcagctggtgccaaaggcagagttagagtctgtgctgtgggccntggaagatgggaggaggggcttgaggtttgcaaaggactgggagttcctgaggaagggggaatctgcctcttgttgccatgggcagctgttgtaggagcaggagagaaaggagggtgggtggtctcgaaaagaatattgggcaaaacctagccaattggccttagctgggagaagtagtgactcctgcatccttttttaaggtttaggaacctgagttcagaaacacctctcatggaagctgtactagttgtgatttacttaattccttaagttccatgacctgaagttaaccccgttcttcctctgctctcaacccattgccccttgagataactgtacatgtcactctgatcatggtaacagcatccctattgcttctgccagctgtcatggcaatcgtgtttcccatcacctgggcggttcagagccagtcatgggctgctgaatttaatggagcatgtttccaggttcttcatggcaaactgtactcatgacttaggagtgagtgttacttccatgtgcctgtcagcttgtgagggggaatgtggaggaaggtgagaaatacagctcccacagttgtgctcttcctagaggaagctctcagaacgcagccctcacgggatttccttaggtcagaggagagcatcgcatctcacgtttttaggtttatcactgccatcccacttctgggatgggaggtagcaagggcttctgtattttcttgtgttcattctagcaacccagacatttccggatcagatcctgctggtctccactcactggaaagtctgccagatgccgatttgagagctgcctgtccctgctttcaggaggagcggggagaaaaactccaatggtctttaatggtttctgcagctggccatggccaattcatatgacattgtgagtttgctttcttatagagctgctctggggagaggtttgctattgagatgtaacagtggagctgttgggtcttcatgactcctttgcgtgtgttccatgggactctctttctgggttccccatgcttatagttgcctcgtgtcacaagacagatactaatgtcaggtttgtggcttcctgatggtttgggtggggccccagtgtcctggtaatttataggactgcctcatctgggagcattgccttcttccttagtcccacgtggagtgaccagtcttcctccttgtagctgaacagggaggaaacttgcaccattacctgactgtggaagggtggcccacaagatgagctgtgcaccataaacacagcccacctctgatttgtcatgtggtacctcttctttccttggcttccatggtagtattatcaactaagcaagattgtgatcccagaaattggcttagcatgtgagtgttgcctcgtgagagtacaagtaatataactcgccatcttgcaggaagtgccaccccaatatagagcctgaagttggaatctgttgagatccttgggtggctgatatacagcctgggatctttcttttttttgttccttttcaaccacccataattttaatattattttttagtgtgtgtgtgcctggctttgcgctagatattgtagaaaacaaaaaaggtaaaagacgtaatatgtggcctaagggagcttttaggtgactgctgcacatcaagcagaaaatcaaggactatctaaagacgtttatagtagataagatcagggtagaccagatggtctgggaaagttctgtgcctctgaggctttgggttgtagtcaatggcaggacagacagtgagatgaaaaacacatgagcaaaagcaaggaagcagaaatctgcatggcatgtactgaacagtgcacagccctgttagagcaacatggttaaagaatcctttccagtgcggttttctagatggaagcttcccagccaccaggcagacctgagtgccaaggggttatgatggtgaggtggagcccaaagcccaaaggagtcagcaaggctcctgcccattgccagggcctcactatggtcagctcaggccatgtgagggaggcagagcctctgcaccccctgtgttactggggtttcttctggagaactcatacattcaggtacaaaacaaaccaactgaggaggtgtgacccaacctcaccacccacctttctcctcctggggagtgtcgtgttgaactgtgtctgtgtcagtgcactggtcccagccctggccgcagcctagtcctttctctgtggagtgggctgcaaaacagcagcgcaagaggagacagtcttcgtcaggtgtgggtgtttggtgcctgcatgggtggccttgcacagagcagttaggggaagatgagggggaggcatggggctgggccagctctctgggatacagcctggtcagagagtaaatggagcagaggagcaggtgtggcagcacctgcccttcacctccctgaccaggcccgtccctccttcgccagtgctgtgcagagctcatttaaatgtattcctttctaggtctgggcgcggtggctcacgcctgtaatcccagcactttgggaggctgaggtgggtggatcatgaggtcgggagttcaagaccagcttggccaaacagtgaaaccctatctctactaaaatacaaaaattagctgggcatggtggcatgcgcctgtagtcccagctacttgggaggctgagacaggagaattgcttgaacccaggaggcggaggttgcactgagccgagattgcgccactgccctctagcctagacgacagagtgagactccatctcaaaaaaaataaataatttctttctggttgtattttcaagtcacaaattggaaaaggcttacatctagggacccactgttgattcctaagttgtgggtgggtgatatcagtggcctcagtgcctgcataaccctcacctgtttatgactgatctactgtaaccttcctcaggttgagagtgagctgctgtgagccagtgacaactactgctacaacttgctgttacttgaaattcgtgtgctatgttggtagcacaggagtaggcgggcgggggttttggtgtgggcactaggtaagtgggtggcaaccggctctttgggaccattggtgctgacctttgcctggtcacctgcctgtgcctaggccaagtgaatgttacatcttggaacctgagccatggaggtggcgccacctccctgaggagaaaggtgtggccaaaggaaactcctgcatggctcctgctccttccccttccctacatttcacttgggctaatgatgtaagccccccttgaggttggggatggtgtggagatagctgcagacacccctgtaacagacatccaggaagaattagggagtgggggtaattatagttcctaggtctaggggtgagaggtgggagtagaaccagaagtgccctggaatccagccgtgtcagccctcaccccagggcccccaggaaagcatggcctgcttgaagccctctgctccctgcagaaactggggcgaggaggagctttttccttcagttagatctttcccttccctgctgcctcgctcccttagctttggagccctaaagttagtggacaagacactgggataaagctctatggctgctggaaggaggtctgagtctgtgtgtgtgcatatgcatgcatgtgtgtgtgtgtgtgtgtcctcatttgcagaagtcttgctaccagttagggtgttaagagcatctccactgggcggagacctggcatttgttttccactgttaagagaatgacacaccccctgtcatgtaagggaggagctattgagttagacattttccctatgggaatcctcggtttggtttgtgggaaaggagggaatggataagtgatttttatctctaatcgtcaacacagctgttcttccactgaatttgtgctattgcatacatgtagccatctttcttttcactgcagcagtgtttatcagtagttcaaaatgatttatttgctcctggggagtaaaaccttttttattaaaaaaagaaaaagaaaaaaaaaagaaagaaaagtgtgcccccctcctatgctgcgatagctataaaatgattgggtcacaaaggtcaagtctgcacgtccctgtggtagaccctgctttcacattggagccttcacactcagcacaaaatgattggaggccttgataaaatggagagcaaagtcttgggagcagtgaaatgggggttggatcatagagacaggcgctggggactcgggtactgcagttaggaaagtagcgttattagttccagaatggggtgtctgtatatactgtattaataggcatgtttgactctcgtaaagggacgttagtagctgctgcaggtcctgtttggaaaccccatgtacaattcccagttttttgtaagtgtcagtgcgagagacatttgactcttgtgtttgtatctcctttttatgattgctgtacctacccatgtctttttggggaggggtgaaaagagatttgaaataaaaatgtttagaaatta

SEQ ID NO: 8992 - DNA, 3066 bp, Homo sapiens
  misc_feature (45)..(45): n is a, c, g, or t
atgcgcttggagggagagggccgctcagcgagggcgggacagaanctctcccgggctgggagtgcacggcgcggtgcgcccagggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtacctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaagagatacacatgatgtctttttcttagagattcacagtgcatgttagtgtaataaagagataagtcctacagtagtaaaatctattgaactttgtttacc

SEQ ID NO: 8993 - DNA, 3370 bp, Homo sapiens
tgaaaggcggttgtggtgcaaaggaaaacccacaggccaaggaatgggaagaccaaggttgacacttgtttgtcacgtgtcaataatcatctctgcccgggacctcagcatgaacaacctcacagagcttcagcctggcctcttccaccacctgcgcttcttggaggagctgcgtctctctgggaaccatctctcacacatcccaggacaagcattctctggtctctacagcctgaaaatcctgatgctgcagaacaatcagctgggaggaatccccgcagaggcgctgtgggagctgccgagcctgcagtcgctgcgcctagatgccaacctcatctccctggtcccggagaggagctttgaggggctgtcctccctccgccacctctggctggacgacaatgcactcacggagatccctgtcagggccctcaacaacctccctgccctgcaggccatgaccctggccctcaaccgcatcagccacatccccgactacgcgttccagaatctcaccagccttgtggtgctgcatttgcataacaaccgcatccagcatctggggacccacagcttcgaggggctgcacaatctggagacactagacctgaattataacaagctgcaggagttccctgtggccatccggaccctgggcagactgcaggaactggggttccataacaacaacatcaaggccatcccagaaaaggccttcatggggaaccctctgctacagacgatacacttttatgataacccaatccagtttgtgggaagatcggcattccagtacctgcctaaactccacacactatctctgaatggtgccatggacatccaggagtttccagatctcaaaggcaccaccagcctggagatcctgaccctgacccgcgcaggcatccggctgctcccatcggggatgtgccaacagctgcccaggctccgagtcctggaactgtctcacaatcaaattgaggagctgcccagcctgcacaggtgtcagaaattggaggaaatcggcctccaacacaaccgcatctgggaaattggagctgacaccttcagccagctgagctccctgcaagccctggatcttagctggaacgccatccggtccatccaccccgaggccttctccaccctgcactccctggtcaagctggacctgacagacaaccagctgaccacactgcccctggctggacttgggggcttgatgcatctgaagctcaaagggaaccttgctctctcccaggccttctccaaggacagtttcccaaaactgaggatcctggaggtgccttatgcctaccagtgctgtccctatgggatgtgtgccagcttcttcaaggcctctgggcagtgggaggctgaagaccttcaccttgatgatgaggagtcttcaaaaaggcccctgggcctccttgccagacaagcagagaaccactatgaccaggacctggatgagctccagctggagatggaggactcaaagccacaccccagtgtccagtgtagccctactccaggccccttcaagccctgtgagtacctctttgaaagctggggcatccgcctggccgtgtgggccatcgtgttgctctccgtgctctgcaatggactggtgctgctgaccgtgttcgctggcgggcctgtccccctgcccccggtcaagtttgtggtaggtgcgattgcaggcgccaacaccttgactggcatttcctgtggccttctagcctcagtcgatgccctgacctttggtcagttctctgagtacggagcccgctgggagacggggctaggctgccgggccactggcttcctggcagtacttgggtcggaggcatcggtgctgctgctcactctggccgcagtgcagtgcagcgtctccgtctcctgtgtccgggcctatgggaagtccccctccctgggcagcgttcgagcaggggtcctaggctgcctggcactggcagggctggccgccgcgctgcccctggcctcagtgggagaatacggggcctccccactctgcctgccctacgcgccacctgagggtcagccagcagccctgggcttcaccgtggccctggtgatgatgaactccttctgtttcctggtcgtggccggtgcctacatcaaactgtactgtgacctgccgcggggcgactttgaggccgtgtgggactgcgccatggtgaggcacgtggcctggctcatcttcgcagacgggctcctctactgtcccgtggccttcctcagctttgcctccatgctgggcctcttccctgtcacgcccgaggccgtcaagtctgtcctgctggtggtgctgcccctgcctgcctgcctcaacccactgctgtacctgctcttcaacccccacttccgggatgaccttcggcggcttcggccccgcgcaggggactcagggcccctagcctatgctgcggccggggagctggagaagagctcctgtgattctacccaggccctggtagccttctctgatgtggatctcattctggaagcttctgaagctgggcggccccctgggctggagacctatggcttcccctcagtgaccctcatctcctgtcagcagccaggggcccccaggctggagggcagccattgtgtagagccagaggggaaccactttgggaacccccaaccctccatggatggagaactgctgctgagggcagagggatctacgccagcaggtggaggcttgtcagggggtggcggctttcagccctctggcttggcctttgcttcacacgtgtaaatatccctccccattcttctcttcccctctcttccctttcctctctccccctcggtgaatgatggctgcttctaaaacaaatacaaccaaaactcagcagtgtgatctatagcaggatggcccagtacctggctccactgatcacctctctcctgtgaccatcaccaacgggtgcctcttggcctggctttcccttggccttcctcagcttcaccttgatactgggcctcttccttgtcatgtctgaagctgtggaccagagacctggacttttgtctgcttaagggaaatgagggaagtaaagacagtgaaggggtggagggttgatcagggcacagtggacagggagacctcacagagaaaggcctggaaggtgatttcccgtgtgactcatggataggatacaaaatgtgttccatgtaccattaatcttgacatatgccatgcataaagacttcctattaaaataagctttggaagagatacacatgatgtctttttcttagagattcacagtgcatgttagtgtaataaagagataagtcctacagtagtaaaatctattgaactttgtttacc

SEQ ID NO: 8994 - DNA, 262 bp, Homo sapiens
caggcccagtgggaacactggaagctgactcccttttgggccacagggatggttttgtggctttgtctcctgacccacttacccaaggcaaccggatccccttgtgctccctttaattctggtgacttcctcgggctgggccctttcttcctgtgccaggagaagtggggggctctactttcttcctcccagtgctcggggggcatggagcggagccagggtctgagcctgccggctcatccagcctctcttgctgccctag

SEQ ID NO: 8995 - DNA, 454 bp, Homo sapiens
attgggtgaagagatgtgcactttcctcttggcttgcatatctaccgaagactgtctgggagcccaagcctcaaagcatccaactatggaattatttttaaaggattttgatatttatgaccaagaagttgcagcactataatgtccattataataatgcccatccgggctgggcacggtggctcacacctgtaatcctagcacttcgggaggccgaggccggtgggtcacctgaggtcaggatttcaagaccagcctggccaacatggtgaaaccccgtctctactaaaaagatacaaaaaattagccaggcatgttggcgcatgcctgtaattgcagctactcgggaggctgagggaggagaattgcttgaacccgggaggcagaggttgcggtgagccaagatcacgccattgctctccagcttgggcaacaagagtgaaactctttctca

SEQ ID NO: 8996 - DNA, 418 bp, Homo sapiens
taaagactctttggggagtaaggtttttactataacctaatcgagggcattgacatcttaaacacactcacacagtctccatcagaatagcagtttttctgtctctaaaacagagaaaaagtaaagctattaatgtcactgttacggttcctaacaaagcactgtcagatcaacaacacctgccagattgaggcaagcattcagtccacctggcagatgtctaacccctgtggcactggaatcctacataattaactccacttgctgtgcttccacacacaccaagcttccctctggaaactgccttttcaaggagataattcactatcaggctgatagagtaattcagttatgccctattctgttgttcactgtgaattaataaagtcacattctttttttctcagtacatcagtgt

SEQ ID NO: 8997 - DNA, 419 bp, Homo sapiens
ggtcaggagtatctcccatctgcttcctttctgaagggatcctagctgaactgagtggggggtatgttgtgcacagttaatatgttgttgacacttgaacaactcaagggttacggcccccctgcacagttgaaaatctgcgtataacttttgagtaccccaaaatgtaactacttaacctatcatcaactagagcctactgataacatcaacagttgattacacatgctttatatatgtattatatactgcatttttacaataaagtaagctagacaaaagaaaatgttaagaaaatcatggctgagtgcagtagctcatgcttgtaaacccagtactttggaaggccaaggcgggcagatggactgagctcagaagttcgagacagcctggataacatggtgaaaccctgtctttac

SEQ ID NO: 8998 - DNA, 452 bp, Homo sapiens
gttcttcatcctccagctccaatctgaataatgttcgcctccacatcaaaggcatcagtatgggcagaagatgcatgacattcaaaatgaaatcataggacctggaatcaggcagagctgatttgaatctcaactccactagaagtgccttgaactcttctcttaacttttttgccaaggtgtgggcagcagactcatgttgtaaaaagtggtttctacccccttctactgtttctcaccaaagaatcacatcggcagcctcaagagaagcagttggtcgaagccacagatatggaacccacagatacaaagggctaactgtacaggaatctgcaaggccatttaggaagttatggcagaagtctcagcaagaaaaaatggaagcttggatgaaggcactaccagattaaatggaaagaagtgataacatccagaaaattttagactacaaa

SEQ ID NO: 8999 - DNA, 673 bp, Homo sapiens
aacaaggacaccaacatcgaggttaccttccttagcagtaacatcacctcttcatctaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagtatctgaatcatttaatt

SEQ ID NO: 9000 - DNA, 281 bp, Homo sapiens
actgcattgttggagcttcttgtcaccaggtgcagtaatattgttaacattcagtatttcaccagtcatgctagtgaaagtggaagatgaagcgataacgggctgcacgaagggtgttgagcatttagtaatcagtgccctgggtgcctgttctccccaaggctttctagaactagagtcctatgtgggaaatatggcctgtatctggaaataatgctgtgctggatttatatctttatccctaggagtttgtttgacctgtctcaacctttccctgttta

SEQ ID NO: 9001 - DNA, 422 bp, Homo sapiens
gttttcatgagtcagttttgcctctagaaacactctttgaacttccatagttatatgaaagcataaaatgctatatgctatttttaactcatgtgttctgaattgtaattgtatataatttttacttgagatatagtctttctagaaaccaatttctcagcatcagctagagccaagacttttcagaattttaaggaaaagcatatttcatacgttgaagtcataggtcccttaagacaagttctattttggtatctacatttacaatgggctgagactgtcacaatcgttcaccttcatcattaaaaaggccatattaaagttcctttctcctctaaacttagaatgttaaatgttggccttgtaaactaactttctaagtcctttaaggtttatgtccagggatgtagaggctaggtaac

SEQ ID NO: 9002 - DNA, 189 bp, Homo sapiens
gcaacattgggagaccttgtctctataaaaattgaaaattaaccaggcttggtagctcatacccgtagtcccaactactcgggaggctgaagtgggaggagcacttgggcttcaggaaaatagaggctgcagtgagccatgattgtgccactgcactccagtctgggtgacaaagtgagactctgtctc

SEQ ID NO: 9003 - DNA, 815 bp, Homo sapiens
attgtggtgtagtttttggtagtatttgttagtagttcctaggccaaatgcgttgttggtgttgtgagttgtctctgctgctttatgaaccattttgaccccgaataagaaaatcgctggaatttgctatttgtctaacatcatttccatagtctaaaataaatataaaataaacagcaaataataaatcattaagaaaaaaaacaaagtgagaaatgtccattaaaatgatatatagcataaccacatttattttaagaatgtattccaatatcaaacggcaaattccaacaatacaaaacctgcaatgaacgtttgcaccaacccaatatttcagttgtttaacatttatttagaatatttttctttttcagtatgaaataaagaactactgtactatctataactatttactctgtgacaaaacatttttctaaattgatctttcacagtaatattttaaattattattttcctatggagatgttaaaataaatttagggcattcattatcttagaagttatagaagtcagaatgagtttttggtgtaatttcttttttgtattgaagttttatttttaaatgccctaagtgctgtctgtatttatgtatgtaataagttcataacatgttaaaaaatggatgctgttgtaagctgagattgcgccactgcactccagcctgggtgacagagtgagagcctgtctcaaaaaaaaaaaaaaaagttgctgttgtttttatatgcagcccctatttccttccttaatctacagcttttgtgtcataccttcattcctgccttccaggtaggaat

SEQ ID NO: 9004 - DNA, 858 bp, Homo sapiens
gttgcagtgagctgagatcacgccattatactccagtctaggcaacaagagtgaaactctgtctcaaaaaaattaatgataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggagaaaattttatttgaaagctgggattgttgcatgctgcagaatttttttttcttttgctattgctgtgtaacaaatgaccacacacttagcagttcacattcacatcttgtttattaactacaattctctagatcagaagcctagacacaatgtgactggcttctctgctcagggtctcttggggacaaaataaaggtgtccgctggaggaacatcctttcctgcatgctctgtggaagaatccactgccaagctcattcaggatgctggcaggattcagatccttgaagttgtaagactagggcccctgtttcctactgacttctgctggtggctgccctcagctcccagaggcaacccacattccttgacttttggccccctgcatctcaaagccagcaacagaaactctcttgtgcatggagtcccctcctgctttgaatctctctgactttccttgactttgatgtctaggtctggatttcaagggctcagaaactctctcatgcatgtagttccctcctgctttgaatctctctgactttccttgattttgatgtctaggtctggatttcaagggctcacgtgatgaggatagtttctttatcttaagggcaactg

SEQ ID NO: 9005 - DNA, 332 bp, Homo sapiens
gccagttgaggctgttcctctccttgttttaatagttgaagcagactgaagagaacatttgtggctagtgctgcagaaaaaatcaccaatggctgaaaaaaaaatcagttgaacagcttttggtatcaggatagctgttggacctggagctgtggataaactttaagggtgataatgtcataggagattcacagatttaattctattgaaggagagaacccttatgggattaaccagtctttaaaaaaaagttgactggtgacaaaaatacctaattgtggatttgcaaaaatgttttatttattaaaatgatacatgctaatgaggtataa

SEQ ID NO: 9006 - DNA, 451 bp, Homo sapiens
tccgtctaaaaaagaaaaaaaagagaacaactgccccttctagcagcagcccagatggagacacccatagcagggcgccggatccaatctcttcctctcctccctcggccttcctctccccacaaaccccagggtctagaaagtagaaggttctcccctcttctctccttcctcataatgaactcgatggagctggcccgagtgcagtggtggttacagttaattgatcacaacgacttacagatttttttgttccttctccactcccactgcttcactggacgagccaaacacaaattaaataaataggcaggtcacagtggctcatgcctctagtcccagtgctgtaggaggccaaggtgggcggatcactcgagcccaggagttcgagaccagcctgggcaatgtggtgaaatcccatctctaccaaaaaaaaaaaaaaaaagaagca

SEQ ID NO: 9007 - DNA, 443 bp, Homo sapiens
tataagaaagcgtttcataaaaaaataaagcagaagcatctttctcagggttaaacaaggcagaagatgggacctctgtagggtggcatgggtttgaggaatggagttgccccccagcaggctgtgagctattcagggttaaggaccatatcacatccatcttttatttcttgcaattgtaacagtacttgttacatagtagtttctccaaagtattacatttaggtctagacacctggcaggcactgcctgtagtctcagctgcccggaaggctgaggcaagaggactggaggatgacttgagcccaggaggtggaggttgcagtgagccatgatctgtcttctgtcactgcagtacaccctgggtgacagagcaagaccccttctcaaaaaacaaaaacaaacaaaaaaccaaatggcaacctttgtttgaattggatggg

SEQ ID NO: 9008 - DNA, 312 bp, Homo sapiens
ttttgaaatataggagctgtgtatttcgctcaacagttcaaagattcccaacaacctattttattccccatgaaggccctggtccaggtcattataatgtgaaaatgcctccaacaagctctgtcacttcttgttttcaatccagagtccctcgattcttgcccagctgttcaaaaaccccaggcccaggagcatatacaactttaagacaattccctaagcagtctccgaccatagccaaaatgggccaagagcatagccttttcttcaacaacaacaattggcttttaaaataaagtgatcttggcacca

SEQ ID NO: 9009 - DNA, 364 bp, Homo sapiens
tcatctgtaagtcttctcagcagaaatgtgtactcagtgctttgtccatttcttaaggggttgtctttttgttgttgagttgtaaacactatatattctgtctccaagtgtcttatctaatatgatttgcaaatattttctcccattctgtaggttgtctttttgctttctttgtaatgtcctttgatgcacaaacatttctagttttgatgaagtacgatctttctgtttttcattgtgttgcttgtacctttggtgtcatagctgaggatcctttgccaattgcgccctggacttcccaagtcatgctctgccctggcctctgcgtcctcgctcctccctggtcctctgcgtcctcgctcct

SEQ ID NO: 9010 - DNA, 481 bp, Homo sapiens
atcgattgtgtcaacaaacagtgggcaattagctgccctgattttcggaaccgagccaccggggagctggttgaacagtctcccactgctttgattaaagaggtgcagttgctgagcctttaggccttatttctgaaaaatggatatgaaagccgtggttggagctgcttttcctcttgggattttcacataaaatcagagactaatccctcatctaataccaatttggtaagggctgggttagaacatagtcaactccactgatgaacatcggttaagatttctttatagaaagctatactattttcagaagcatttcagacaaacatcctaagaagacttagcaggctcaagatgtttaccttggacctgaatcttatttctaattaaccgagtcttcaacagtccatcagagaatgcagttacctgccaaatttcacacctaaggggaaaaaatattcccaataaaattttccttaaa

SEQ ID NO: 9011 - DNA, 1954 bp, Homo sapiens
  misc_feature (1)..(1): n is a, c, g, or t
  misc_feature (191)..(191): n is a, c, g, or t
  misc_feature (1024)..(1024): n is a, c, g, or t
ntttccgcagctgagcggcgacccgggcggcggcggcggtcgaggagctcccatggcagggacgaggcggagggaaggcgaaaggggggcgaggagttaagccagagcctccgcggggcgggtttccgagggaggcacagagggaaacggctctcgcagcccgaggagggtcaggcgcggagcttgtcgcncctcccgcgcattctgtccagcccgggctccggagatgcatctgcatcaggtcctcaccggagctgtcaaccctggagacaactgctactccgtgggcagcgtcggggatgtccccttcacggcatatggatcaggctgtgatattgttattttggcaaatgactttgaatgtgtacagatcattcctggtgctaagcatggaaacatccaagtcagctgtgtggagtgttctaaccaacaaggaagaattgcagcttcatatggtaatgctgtttgtatatttgagcccttgggcataaattctcataaaagaaattgtgtaagtattaaccaataatagaatacttttagaatctagttaactttagaatccaattgatgttaataaaaagctccttaggagctagtgctgaaaatagactagagtatcagtgaaaaattggtctagtgctttatgttaggatccttacattcactacggatacatccctagtgcttttagaaacccaagtctctagaatattgcaaattgacatttactgtgttaactgagatctaccctagtttgaactactgttatttcttgtctggattactaatatctatctgatatctggtttcctgctgccttcagccccagtgtctgttctcaacagaggagatcatgacatttctctgcttaaaactttgtaatggttccatatttctctctcttttttcttttgttttgagacagggtcgcactgtatcccctgggctggagtgcagtggcatgatcactgctcactgcagcctcaacctgtcaaatggtcctcccacctcaacctcccangtagttgcgactataggcatgtaccaccatggccagctaatttttaaatttttcgtagagatggagtttccctgtgttgctcaggctggtcttgaactctggggctaagtgatcctcccacttcagcctcccaaattgctggaattatgggcatgagccaccatgcccagctgctccatatttctttcagataaaaagccaaaagccttttgtagactacaacttcccttctactcagtagcacagttactatgtctcagagctcacctcgtaagttcttgtcctctctggttctactctggccacattggcatttttactgtttctcagttaaccttccctctttgagcctttgtgttgtttgttttctttgtcaggaatgttattcctccagctatctccaaggatagctcccatagatcctttaggtctttgctcactaataccttgtcaatgaggtttaccttgaccaccctttaaaaaattgtacccccacttatcttgctatttaaaaatttttttacagcatttatttatttattgtttactatgtaaaatgttatctaaaggtacataagggtaggaagcttttttcactgatgagtccccagtacttagaacagtatctggaacagccaggtgtggtggctcacacctgtaatcccaacactttgggaggctgaggcgggtggaacacgaggtcaggggtttgagatcagcctggccaacatggtgaaaccccgtgtctactaaaaataaaaaaattatccaggtgtggtggcacgtgcctatagtccctgctgctaggaaggctgaggcaggagaatcgcttgaacccaggaggtggaggttgcagtgatcctggactgcaccattgcactccagcttgggagtcagagcaagactccatctcaaaaaaaaaaaaaaaaa

SEQ ID NO: 9012 - DNA, 388 bp, Homo sapiens
ctgccttctgtgtccatctcgttgggagctgtagaccagagctgttcctattcagccatcttggcagctgtccatccaaatatgatttctttgaataggtcaaccttgtatatgatatgtaaaataaagcctgctgaattttttgataacaggggagagactcttaactccagtacacttccaggtatatttatggaaggaaataaaccatgaatactgtattgagattatatgtaattagtttatacattattatgaaaaggaagatatctttattttacccttttctagatattaatgctgtatttattcttttttagattgcagcttcatatggtaatgctgtttgtatatttgagcccttgggcataaattctcataaaagaaa

SEQ ID NO: 9013 - DNA, 449 bp, Homo sapiens
taaaagaagaagaagagacaagcttcttaaaggcaggaaaaggtgctccctggaggactggggcttctctagtttgtggtaaaatatgacttaaggtaaaacttttgttgacatcaatttaattcatggcaaaacttcacacagaaaattccataatatattgagagtagggaaattaagaaatcccaaatgaacaatagagaaggattcaggaactactttcagtctttttttattgacttctttttgatcatcaaagttactttcatctttgtagtgacaatagctttttagaatatttcttacactaattcctgatatcttctattaggctacagtttaccaaagaaatgtcaggaaatacccatgggtaaagctgaatatttcataatctttgtaaccaagagatgttgggttctttccacaaggtcctaggatgtagctgaaaa

SEQ ID NO: 9014 - DNA, 497 bp, Homo sapiens
tatacatttgcagagtctcctgcttagaagggccatgcactctgcttaatgcttttctgctactatctttataaaattctttacaaagttttaaacaaggggccttgcttttcatttttctctgggccctgcaaattacatagctggtcctggatgtgatttaaggtcataaaggtagaaagtggcaaaggccagtgcctttctgatactactcttctctgtttccgaattatgcatgaagagctttaaggtttaacctatttttcccactccctgaaaatactatttgtatggattatgtagctgattggtatctttcatcatggggattaatttcaggaccccttattttacagatggggtaagtgggagctcaggaaaggttaaatactatggatcagtaggaggtgacaggtttttcaacattgttattctggattccagactccacacacacaacaaacgtgctgactcctttgttataacactgtttcagc

SEQ ID NO: 9015 - DNA, 387 bp, Homo sapiens
gttagatgaattctatttttaatctaattaaattagaagtaacatgcattagtatattagctaaatctcatttatttacagtggaatcgaagttggacatattccttgaaaatattttgaaaattattttaatgattaagaatcaattaaaaagagattttactttatttgctaaagaatgactttcaatagtttagtctcaaaattgttacacatgattaccagtgtgaaatatatgagcaaagataaaaataatacctccctgccaaaaacagctcctgttagaaaatattttattaactaatcaaataatcttctggtaaatacagagagatgtttaaagattgcaatcgaattacaaggacacaataaaactaaaggaaatgc

SEQ ID NO: 9016 - DNA, 1993 bp, Homo sapiens
gctctttccactacggctgtattgcactggtgagtccgggcccatggatgagaaattgatgcgaggatcaatacaagcttaatttgaattaattcttgggggtcacgtgttcacaatcaatggcctttgaggagctcttgagtcaagttggaggccttgggagatttcagatgcttcatctggtttttattcttccctctctcatgttattaatccctcatatactgctagagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaaggacctggtatgtgattatcagtcactgaaatcagtggttcaattcctacttctgactggaatgctggtgggaggcatcataggtggccatgtctcagacaggtttgggcgaagatttattctcagatggtgtttgctccagcttgccatcactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatgcaaccagaaatcaaaataaatccagaaatagagacctatataaatgcatttaatacatgatacttttgacataataagccattggaaaacggaaagattagatactaaataacattgactatctctttgtaaatacagtcactaaatgatgttagttacttttccatggtggaattttaattactttttctttgtaatttttctctctgtatattttaaacaaatagctggtatagtttacaatattataaagatattgttcaaattgaagggcaaaggccaggttcagcaattttcaaactgtatgtacatttaataaaataactataaattaaaaaattatatttcaaatgatgtgactaataaatgaaagtacatata

SEQ ID NO: 9017 - DNA, 1608 bp, Homo sapiens
ggaaggttttgtgtgaggatttccagagaaatccatgcttaagccaagacttgaatggtataggtaagaaaatgtagtaaaaagaggctagagagtgtgtccactgaaagctattgcagcaagtgaacaatgagaagacctggtatgtgattatcagtcactgaaatcagtggttcaattcctacttctgactggaatgctggtgggaggcatcataggtggccatgtctcagacaggtttgggcgaagatttattctcagatggtgtttgctccagcttgccatcactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatgcaaccagaaatcaaaataaatccagaaatagagacctatataaatgcatttaatacatgatacttttgacataataagccattggaaaacggaaagattagatactaaataacattgactatctctttgtaaatacagtcactaaatgatgttagttacttttccatggtggaattttaattactttttctttgtaatttttctctctgtatattttaaacaaatagctggtatagtttacaatattataaagatattgttcaaattgaagggcaaaggccaggttcagcaattttcaaactgtatgtacatttaataaaataactataaattaaaaaattatatttcaaatgatgtgactaataaatgaaagtacatata

SEQ ID NO: 9018 - DNA, 1669 bp, Homo sapiens
gctctttccactacggctgtattgcactggtgagtccgggcccatggatgagaaattgatgcgaggatcaatacaagcttaatttgaattaattcttgggggtcacgtgttcacaatcaatggcctttgaggagctcttgagtcaagttggaggccttgggagatttcagatgcttcatctggtttttattcttccctctctcatgttattaatccctcatatactgctagagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaaggacctggtatgtgattatcagtcactgaaatcagtggttcaattcctacttctgactggaatgctggtgggaggcatcataggtggccatgtctcagacaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatgcaaccagaaatcaaaataaatccagaaatagagacctatataaatgcatttaatacatgatacttttgacataataagccattggaaaacggaaagattagatactaaataacattgactatctctttgtaaatacagtcactaaatgatgttagttacttttccatggtggaattttaattactttttctttgtaatttttctctctgtatattttaaacaaatagctggtatagtttacaatattataaagatattgttcaaattgaagggcaaaggccaggttcagcaattttcaaactgtatgtacatttaataaaataactataaattaaaaaattatatttcaaatgatgtgactaataaatgaaagtacatata

SEQ ID NO: 9019 - DNA, 1939 bp, Homo sapiens
gctctttccactacggctgtattgcactggtgagtccgggcccatggatgagaaattgatgcgaggatcaatacaagcttaatttgaattaattcttgggggtcacgtgttcacaatcaatggcctttgaggagctcttgagtcaagttggaggccttgggagatttcagatgcttcatctggtttttattcttccctctctcatgttattaatccctcatatactgctagagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaaggacctggtatgtgattatcagtcactgaaatcagtggttcaattcctacttctgactggaatgctggtgggaggcatcataggtggccatgtctcagacaggtttgggcgaagatttattctcagatggtgtttgctccagcttgccatcactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagagttgtaagatccaccatgcaggaggagctggatgcagcacagaccaaaactactgtgtgtgacttgttccgcaaccccagtatgcgtaaaaggatctgtatcctggtatttttgagaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatgcaaccagaaatcaaaataaatccagaaatagagacctatataaatgcatttaatacatgatacttttgacataataagccattggaaaacggaaagattagatactaaataacattgactatctctttgtaaatacagtcactaaatgatgttagttacttttccatggtggaattttaattactttttctttgtaatttttctctctgtatattttaaacaaatagctggtatagtttacaatattataaagatattgttcaaattgaagggcaaaggccaggttcagcaattttcaaactgtatgtacatttaataaaataactataaattaaaaaattatatttcaaatgatgtgactaataaatgaaagtacatata

SEQ ID NO: 9020 - DNA, 768 bp, Homo sapiens
ccccctccctccatggtaactgtcatgcgttttcttgtggggctgctgatgtgtcgaccctggtgacattttaggaaggctttttatagagttttcttgtgtacacaaaaggtttggaagtttgttttgttttgatctgcagtaaacaggtccttcactttgctgacgtcatttccgttcatatttgagttgttgattgtgcttctttgcagggccctcttatccctacccccgccttgcctttcagctcagagcctgtggctgcctggggaagggggagtgtgctcctaagctgccaggtctgggttcaaaggctgagggtcgcgtggctgtgcctcgtcctagggtttgcccgctggggaagatgcttccagcttcaaatctggttaaacactccgacatccactcgccctggtattttcatggcacgcagtgattcatctcagcttcctttctttgtaacacctccccccactttgcccctgccacaccttgtctgtgtctttaatacatccttattgtccacttctccatgcccccacccaccgaaaaaccttgtaatgacgactcggagactttgattcagttgcaaatctgaagctggcattagtggacctcatgctgtgaaaaaaagaaagtgtttcaaggccttgcccccgcagcctccccaccaccgccttccatccctgttgggttgtttgtgcatgtgtgtttctccccgtttcctgccttttcgtagatataaaggccgttctggtgtcactaaaa

SEQ ID NO: 9021 - DNA, 618 bp, Homo sapiens
cagcttcaacatattgaaaaatcattgttacttctggttcagcgactcagtctaccttctcacttgccttgttaacataccaccatcttctgcctttcttctcaagaagaaaaaaatcagacctcactgacgcttcaccatcttcagcccctcattcccaatgtatctaaaaggagctgtgccactttttagaaaatcaaccctcatgcattcggcacctgttattatttctagaaactgtattaagcctgtggacaaacagggccctggttgtcatggaatttgaagccacccttttctgttttgattggatgcaggaacaatgagtacacaccacacccagagtccatcccttgtcatatcaagtccctctttcttcaaagacaacctcctacctgtatcttgcagattattgccaaaagaaatatcctaagtggcaattaattgctctactttatcttcatgaacctaaactaactctgtcataagcctagagttttcttatgctgagcttttgaaacttttcataatctgatattcactcttaactaattcccacattcccccaataattcccacttttccagccaagatatttggagctcactatccccttaa

SEQ ID NO: 9022 - DNA, 801 bp, Homo sapiens
  misc_feature (779)..(779): n is a, c, g, or t
  misc_feature (781)..(782): n is a, c, g, or t
cttttggatgagatgatgttgcttccttctttttctctaggaacttttggagtaaaatttctctctggtctcaacactagacatagtttttgtttttattcttagcaaatggagtgtttttatcttacagatactatgaattctttaaccgatgtttccttcttttccttgttcactggaaaactgagaggcaaatctgaggtgcatgcaaacgtacctagtgttggggcatgcggtttcgcactggcccattcctgcagtgtcttgtcttttctccttttgtcttcctttgtcttgttttctgccttcattcatcttaccttttattttgtgtgtacttatgttagcttctttaaatccttctggcaacaaggtatggagtccttttcggacacttcagcctaaaattaaatacaacaactggctgtttccccagaggtcttccttaggcctcttttcttgcatttgagttaccgcttactgagtgggtgtggagaaagcacgtgtggggctctggctggggcgtttcagttctttctgcctcactagctctgtcactcagggtgagtgcttcaactttgctgagtgtttctttgagtctagcatgcggattatcgtgctttctttgctaggtaactgtgaagattaaattaggtaatggttattcatgaacaccatgcctgacacacagtcccaaacgggcccagtgacactgccgactgcaccccagctcaggcccccactgcaccagcaatgctagaaaaccaagccaataaaananntttcttttttcattaattt

SEQ ID NO: 9023 - DNA, 454 bp, Homo sapiens
ggtaaagttaagaatccttagaccaggttttgtgaattcaagtcccaagtctatgacttatggagagtaaaacctcagacaaattatataacttctctgtgactcagtttttagatctttaaaattggccactgagcacctaccttaaagagttgtgggtgccggacgttgtggctcatgcctgtaatcctagcactttgggaggccaaggcaggttgatcatgaggtcaggagtttgtgaccagcctggccaacatggtgaaactccgtctttactaaaaatacaaaaattagctgggtgtggtggtaggcgcctgtaatctcagctacttgggaggctgaggcaggagaattgcttgaaaccggaaggtggaggttgcagtgagtggagatcctgccactgtactccagcctgggtgaaagagtgagattccatctcaaaaaaaaaaaaaag

SEQ ID NO: 9024 - DNA, 764 bp, Homo sapiens
gggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccaggtgatggtttttggttatggtatgatcctttcacaccgaggatttcattgtttaaaacgtgtttctttaaaagaagccttgataacgagagtgggggaaggaggcagcagactttgaagactgtggcctttggtgttctggagtagggggagggaaggagaaacatgttttccacatcatcgcaagtgtgtgccctttgccccttttcaggatccttagagttgcctccctccctccaccccgacagttttgcaataatgtgccttatcagttgtgagtttacaggtgaagcaatttcccaaataaatggatgtaagtgt

SEQ ID NO: 9025 - DNA, 1058 bp, Homo sapiens
  misc_feature (832)..(832): n is a, c, g, or t
  misc_feature (836)..(837): n is a, c, g, or t
  misc_feature (861)..(861): n is a, c, g, or t
  misc_feature (919)..(919): n is a, c, g, or t
gggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccaggtgatggtttttggttatggtatgatcctttcacaccgaggatttcattgtttaaaacgtgtttctttaaaagaagccttgataacgagagtgggggaaggaggcagcagactttgaagactgtggcctttggtgttctggagtagggggagggaaggagaaacatgttttccacatcatcgcaagtgtgtgccctttgccccttttcaggatccttagagttgcctccctccctccaccccgacagttttgcaataatgtgccttatcagttgtgagtttacaggtgaagcaatttcccaaataaatggatgtaagtgttctgtgtggtgcttgtttgaacatgttgctaactttcaactacctttgccagtgggaattaggattgnctgnnaattggacagtccaaaatggtgtnttaagctttccactctcaatgcttcttaccaaaataatttctcagaagccagattttnatcttcattttctctctctgctccctgtatagtggggtcagtagtaacaggagtagctaccggatgggcagcaggaaagcatagggaagaagcagagtgccagtctagcttttacagaatactcaagaagaggctgtca

SEQ ID NO: 9026 - DNA, 951 bp, Homo sapiens
gtctctattcattatatggtctaggttgagacttccttggaagcagaacctgagtaccaggaactcatattttataaagtatatttattccttttagctgcaaactaacccagccatgttttagtgaatgctttaatctgaagatgactttgagctcattgaccatattaatctttcatcaaacaaactggatgttgtttcattaacaaaaaactcctccacaccaaggagtgtttagtaacttctgcacagaggactcatccatctcttgcttatgtttgggacagaaagacacttctctggctttttactggcttgaacccaatgggacagagactctctagaaagtttcagggctcacattcacttgtttgtccaaaaaatatttttgagtgtctcccaagtgccaaaccctggctactcccacctttgcctgagcccatgagcggtagtctgggggctggatgtgaggagttctgagttggctaggaagacacaaggcacaatggacatggggcaaagtccacttgctggacattggtcccttccacttccaagctgtccatcaggctgagagatctggaatgcataccccacactttgaagatgaggaagggcgagtttctcaaagtgtgtgtgtgtgtttctcttttaatctgtaatggtttctgcattttgaggtagaaacagaaatctcttttttgagtgggaccactcgggtgcggcttcttagtcttgttgatataataaagcacatgcccactcctcatggagtggagaggagaaaattctaagggaacgtactctgaatgcaaatgtttctgagattaaacactagtcacttgttaaaaaaacaagagtagaaataaaaagagaaaggaaggaaagagaaaatgagtaaaaaagaggatagaaagaaaaaggaaaacgggggggggggggatagtgtgg

SEQ ID NO: 9027 - DNA, 821 bp, Homo sapiens
  misc_feature (676)..(676): n is a, c, g, or t
aatctcaatactcaaattagaaaattaggattgcagatataatctattcattttccatttatttattcagcaaatatctttcagcacctaactattttaggtgctggagagtttagtgttgttgtaataacagtcagtataagaaattataagatgactgaagaactgaggctagggaaccatatgcctgcttataaccaggacaaactgaactgtcagcccaaaagctgaggaccctgaggtggtgagtgtggaggagggtgtgcctaccaacagtgttcccctgggtttctatgtttaaagggcaagtatgaggacgtttagtaaaatatgtaaaatgtagtttaagcatttaggccttttctcttgctgaaacttgtaaaaccatttaggtaagatagatttctattaacgttaaatagcataagtcatgaataaacataagtccataccacaaagtttatcaatgtatggcaggtatgtggataaatttccctattgtattctctatgttaagctactagaagaaagagtaatattttctgagcccgaaatgatgagaaaagattgtgtttttgaaacagcaaaattaggcagacagttgtaacatttttttaaaaatacactagttagcttggtgttctgttgcatttgaaaatagcatgatacagtatcnatcaactcttaaattatgttggaagaaaagataggaaacacatcaaattgttattagtatctggtgaattcacaggtgacttttttggtctcttataatttcattatatattctacagttcatgagtattacctttataatcgag

SEQ ID NO: 9028 - DNA, 487 bp, Homo sapiens
tgtgctaggaatacaaagtttaaatgataaagttcctgccttagagacgtttattgtctactggagaaggtgggcatataatttacccaggtgagtaaataatttataaactcaagtaattagcattgtaatagaagttgcctagtacttgtgtatctactatctctgctaaaaggattgaggaaagctttactgaggagctgtcatttgagcttggtcacaaaagatgagaaggaatttgccaggtaaatttgttcaggaatcagagattctagacaaagggaacttcatgtgcaaacgtaaaagagcatggcaatgttggaaaggatcaactggagctagagcatgggactctgtatatgttgggagagatgaaatgagaggcatggtggagcttaagtgctgtgctatgaatgttgacctcatcctatagacagcaggaaacaaagtttttaagtggtaggtgatactataaggcttttttcaa

SEQ ID NO: 9029 - DNA, 392 bp, Homo sapiens
cccaaatcatagactaggaggtggcagagctgatctgttgacttttttttcataatgttactcttgcactctgcaattacatcaaaaaaagatgactttttctgggcgcgatggctcatgcctgtaatcctagcactttgggaggccgaggtgggcggatcccctgaggtcaggggtttgagaccagcctggccaacagggtgcaaccccatctctactaaaaatacaaaaaaattagttgggtgtggtggcgcgtgcctgtaatcccagctacttgggaggctggggcaagagaatcgcttgaacccaggaggcagaggttgcagtgagccaagatcgcaccactgcactccagcatgggcgacacagcgagactccctctcaaaaaaaaa

SEQ ID NO: 9030 - DNA, 360 bp, Homo sapiens
tagtgtggcagcagtgccactggtctctggggtgggggcaagactgtcagagagtagagccccaggatgagcagtactcctgaaaatatgcctggaccaatactggcagcctcccctgacttccaatagaggctgctgatgacagggctccatgtgaaggggcaggcagtaatgctccccttcccagaggcaaaggctggttggcaaatcctacccttcttggtcagtcatattctttctgggtcttagattctaggagataggcttctggaaacacaatttgtggatctacatgaagcatggatcctgaaattattttagagccagtgtggcagggctgtgggactatccttggcttca

SEQ ID NO: 9031 - DNA, 760 bp, Homo sapiens
tgaaatggagtcttgctctgtcgcccaggctggagtgcagtggcgcgatcttggctcactgcaacctccatctcccaggttcaagcgattctcctgcctcagcctcccaagtagctgggattacaggcacgtgccaccacacccagctaatttttatctttagtagagacggtgtttcgccatgttggccaggctggtcttgaactcctgacctcaggtgatccacccaccttggcctcccaaagtgctaggattacaggcatgagccactgcgcctggctgagaagagcagctttaaagtacatcataataatggtgggtgtttccttcagttaggaaatgagcattttgctatgatttttattttaaaaaagagatggagaatttttgaaggtatccttatataatgatttatctgcacatgtatcattattaatgtatcaaaggaaaatggaaagtgacatgttgattaactagatttgattaatttgattaattagatttcttccaactcagtgacatttgtaacacgtgacaggttgcttgataaagggtaacatttctcttacaaatgctacttttgttattttttttcttttggtgatctgtgctgtcatttgcatgttagtaatctgattttaagaattttgtattttggggaacataaccatgttaaaagacagtttattttagtactgaaagaaaatagttacttttactctcatttatttaatttctgttcattttttccctgtattta

SEQ ID NO: 9032 - DNA, 352 bp, Homo sapiens
aaagcttaaactatggggaaagtcttgcctgttttccaaggcttcctccaccctgccaccgaagaacttacctggatgccaacctgggacccctttgtctttgggcttttgccctttgaaactgtgaatgcttcaagagccacataaatgctctggcagtgtctccatgtaactagtaaattgtcctggctggattcgttgtgaaatggaactgtcccatttactttggttgcaaataaggaagatgtatgagtattggcctggaaatgagccctctagtgtagagaggttattctgagggtttaaactacatggataggccttgggttcaaggttacaggaaaggctgtaa

SEQ ID NO: 9033 - DNA, 214 bp, Homo sapiens
tgcctggctgttttccactcattttttgatagcttaggcattatcttttcaagtgtcttttcattggcttaacctccctgccaaggtgggttgaatctccctctttaagtttccaataccatgttgcaaagatctctttcagaatgctcaacagatcgtattcaaatgatatacatgcttggcttcctcaataattgtatgatccaagatgata

SEQ ID NO: 9034 - DNA, 282 bp, Homo sapiens
aaactcatattctgtatataattgtatatacattgggtttttctcccttatagcaattcacactaggagtctcagtcaacatgattttttaatggctgtataatattctagcgtatgaacacatcattatttaaccattttcctgtcactgagtgagcctgtttgaaggttttgtttttttttcaattgaatgttatgttgtggtgagcagctctgtatataataattaattgtctgtgtttggatcataaagttagcattgactccaaaaagtgaaatcac

SEQ ID NO: 9035 - DNA, 410 bp, Homo sapiens
acgcctataatcccagcactttgggaggccgaggcgggtggatcatgaggtcaggagtttgagaccaacctgaccaagatggtgaaaccccgtctctactaaaaatacaaaaactagccaggcttggtggcgagcgcctgttatcccagctactcaggagactgagaacacaggtgcacactaccatgccagctggacaggtacttttcctgaagacaactgttatacttcagtacgaaacagaagtcctttatgcatatgctccctacttgtcacaaagattttttaaatgcactttaggatcaagatttaataaaataaataattgtcactgccttaattcatgttaaaacaccagagaatgtacccaccattacttttgcaacattgatgcaaatgtcagcacagta

SEQ ID NO: 9036 - DNA, 2235 bp, Homo sapiens
gaattccggctggcaggggagaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagactccctgcctggaccagcctctccactcatgtgactctttccaacctgctttgtggcactggggcaggggccgggggcagtctgagagaggccattctttcccaacacctcttggggagtttagggtgggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggcctggc

SEQ ID NO: 9037 - DNA, 1273 bp, Homo sapiens
gaattccggctggcaggggagaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcctgctgaagccgttgcgtgccacaagctttgcaattgtcccgcaagtccccttggctctctttgtgcccgcccttccttttt

SEQ ID NO: 9038 - DNA, 392 bp, Homo sapiens
tgacaggagtgtggtgcgcttctgattgtgcggcactgtcgagcgtgttcctaagagcgaatgtctgtatcgagcaggtattgatgagaatcaagtcttcctggtttatattcacacacctgctggtgggaagaattttccacagacttccggctccacatatatcaagcctcatctctcctccacaaccggtactccctgttccaggtcccgtaggacacgttcctatcacagtacaaccgtggccttgctccttctggttacgacaccaggtgtcaggcaatggacaagaagcatgttcttgaagccagccctaccccaggatgactggcaatgacctactaaatgcagaagtgactgtgaacgcacaaatatatcccactaacctcaaa

SEQ ID NO: 9039 - DNA, 457 bp, Homo sapiens
gttttcctttccctatatccctttcattaacaatcaatctcaaaatggttagaagtatcagatattatatctgtaatttagcaaagcaattaaaagtaagaaaatcataaaagtattcaggaaagaagttatttattattattctggtcagtgttctgaatgattttcaagtattatagctaaatgtgaaaagtagctattttaagacaaatgacaacatttgaaactctgcatattaactgaaaactatgaaaatatatttggtactgtaggagatgaagtaattatttcaggaattagaatggaatactacttttctccatatttggctgcagaattggctggagaacatctaaaaatctgtattttattaataaaatacacagagataggacactgtatttgctgagagaatgagctggatttacataataaaaacgacaatgctatttgaaaa

SEQ ID NO: 9040 - DNA, 453 bp, Homo sapiens
aacacagctgtgtgttctttccagtcgcttctgttcccagacttcaggcaacatggcagctcccatacttgccagggtagttggaagggcagctctggagacaggaagtggaggtagaagcaaaggaagggagtccttggctgggaagtgcttgggttcggacagacagggaagaagggaaagtatgaggtgtgttcagggaagcttagaagggcagagaggtttcagtaggacatgtatgggctaaagggtcagttagaaccagagtatggagagtctgggatgccatatacaaaagtttgggctctaacagtctcctgatgaggagcaattttccaaaacatgaaagaattattctaagaatgacaaagggaagttaatataaattatgactaccacagggtttggcaatctcactaaccaccattaaactgaggagagaacaaaaaaaaa

SEQ ID NO: 9041 - DNA, 1045 bp, Homo sapiens
cctttggaaacaacggcaagacttcaaagcagatcaatagagaaataccaagacctgaacttcctagcaaatgctctcttctattttaaataatttgaagaccttttggtgtactcaagtcacaaaggatatttggtggtggaccgtggacaatccagaccaaacctccagagggaaggcaaccaaggtaccatgtgaaggcctgggcatataacatgaaacaagaaagataaggcccgtgcttacatagaacttggtgaagaatctagaccataacaagcacacagagaaaacgtatcacaaattgtgctaaagttctgtaaagggattaagatgaagtgtcacaagactgaattagacagagtgcccttgaaagagtgccaatttttagaatggagggtgtagatccatcctttgcaactggtgaggacctcctcagtaaggcactgagccaggagtctatacagccatgccaacagggagcactgtctttcattgtctgatgttattgcaaacctgttcttttcagctttcgtgtttcagcctagtccaaagacgtttacatcctggaagagaacttgctggcttttcacctcagcatgtatgggccaaactaatataacaagaagtcttgagaggagtcagcggccaagctccatgtcttgcagccaaacaatgctgtgggatggaaggtgggatgtcatgtgtctggtttacagcactcacgtatcagttggcagttaacggaagtgctactgattgtaacagtggaagcaatttgaaatgaaatacaacacttaaagcaaatgaaacggaagtgaatgccagcagtaaatggcaagaagaaatccagttcagtgtgttcctcagaaatcttgcctcttgggactaaatgctgcaaatttaactcttatccttgtttttcaagttttaccatctcaaagctatccactttatattaaattagttctgttatattatgtcaatttgtattcttaagagcacaagtttggcctcaaatagacctgagctgagatccaattct

SEQ ID NO: 9042 - DNA, 461 bp, Homo sapiens
gttttcctacgtaacaaacctgcacatcctgcacatgtatcctggaacttaaaataaaataaaataaaatttttaaaaagaataaataaatagcagcctagtccaaagacgtttacatcctggaagagaacttgctggcttttcacctcagcatgtatgggccaaactaatataacaagaagtcttgagaggagtcagcggccaagctccatgtcttgcagccaaacaatgctgtgggatggaaggtgggatgtcatgtgtctggtttacagcactcacgtatcagttggcagttaacggaagtgctactgattggtgatatgcctactcccccttcaccttcgatcatgattgtaaacttcgtgaggacatcaccaaaggctgacattggcaacatgcttcctgtacaatctgcagaacaacgatggaacaaaataaacaccttttctttataaattacc

SEQ ID NO: 9043 - DNA, 578 bp, Homo sapiens
  misc_feature (578)..(578): n is a, c, g, or t
ggagaagaccgtacttttcgcccccctcccacctctcgcccttcagttgccaccaaggtgcttggtccttccgaggaagctaaggccacattggggtgaggccatcacttcatccagtgactagcaccacctctggcaatgtcagccccacactcgcccgcgccatggcctccatctccgagcttgcctgtgtctacttggccctcattctgcacgatgacgaggtgatcatcatggaggttaatatcaataccctcattaaagcagccagtgtaaatgttgaaccttttggcctggcttgtttggaaaggccctggccaacgtcaacattggaagcctcatctgcaatgtaggggctggtggacctgctctagcagctggtgctgcaccagcaggaggtcctgccccctccattgctgctgcttcagctgaggagaagaaaatggaagcaaagaaagaagaatctgaggagtctgatgatgacatgggctttggtctttttactaaacctgttttataatgtgttcaataaaaagctggcctcgttggcctcagcggtggagctctgcggccggaan

SEQ ID NO: 9044 - DNA, 545 bp, Homo sapiens
agtgttgccggtttaaaagccgtgtttgagtactctaaagtacttttctgtgacagctattactataggaattggcaccagctaagaaaatttacagtttaatactttagagcaaataattgcttagggtgctttaaatagcacaggaaatgtgtagagtgtttacttgacatttgctatattgaacactaatactgaaacagattctttgaccacagagaatgccagtgtaggaggggtgggggtaggtgggagaaagaggcggagaaggaaacggcaatacaattagataaaaattaaatgacaaatgtactttttcatgatacagagatatcatggggaaaaatgcccatttgtttgatcaagtaatcttctagtgtggtagcagaaagcaaagtacagacaacttcctgggattaggttcctcctgctaaaggctgtcttcaccagaaggtcaaagccttgcagcccttggtcgctctggtttatttttcaagctcctgaaagcaagaggaatgacctccgtttttattaaaaaaaaaaaa

SEQ ID NO: 9045 - DNA, 870 bp, Homo sapiens
gaagatgtctttttccagatgttctttttatttaactaaaatgtctctagcttctttccatttatgataatcctgcccttttcgacccacagtgtagctcagaggaggaggaccttaagaaaaactgagattcgttattcagggcccatggtaccttaatctagaaacacatatcccaagaaatattttctttttaaaattatacatcaactttatgccttattgtttaaaaatcttctatcaaaagtatcatcgataagacaatttatcttgcttttgtacctcataattaccctaaaatgtgaagtttctagtctcactgatttcagatgaatatttaaaataatttgataagtttaatcaattgaactctactgtgtgagtgagggagagaaaggagttatttttgtgttttgaagaaagttgacaggatggaagatctgaaattatggctggggattgtagtgatagctggtagctgaaaccacccaaaaaagctagaaaagtgttctcttatgcctccagagatacctagaaaatatgaagaatgtggaaaagagcaagatggaaccctcagagtgtttcagataaggtctgttggtatctccataagcttttctcctatttggagaaaatagactctcactgaaactcttcaatgtttttaccctccatccttttcttagcaatctaaactcaatggcctcctgttccccaacactgcagtctgggcatctgactttgtcttccctctgcactcatttctgtgaatcatgaccagggatgaaactgatatccctagttcctcttccccatttcttctcacactcccctgcctgagaatcagttgagttcccaatacctcttcct

SEQ ID NO: 9046 - DNA, 765 bp, Homo sapiens
tgttacctgttttttttagacattatcttagcaagaatggtaagtctttgaacttgataggaatttggtgggttcaagctttcaaacttttttttgtaatatatccatttgggaagaggtgcagggaggaagaggtggtgattataagtaaggaagtgtggaaaaagttgtaaattcttgaagaaagcatgaggtaaggttttactcctgtttttttttttttatccctgtgtgccctttagttcagtttagttcatacaaattagatagacatgagcctctggttgagtctaatcttgaaaatattttctttgtgatggggttggttttagaagagtagcctggaatacgaaagcttttatttgtatggttatcatgtgtcttcaacctttatgtcaataattgcagacttagaatagcagttctaagttaatggtaaaatgttacctactttcgattccatagcatctatcttctttgagtactttcttagagtgtgattttaatgattatgatctttgttctaactattttgaggcttcattaaaaaataaattatgattttattgttagaatcgtttctataaattaacgtcactgcgcctggcccttaaatgtaaatttgtttttatcaatcaactatttcttcataaaaagcaaagaatacgattagaaatttgaagactatctggtattttaaaaataaagttcatctttctggccggctagttcatcgtctaacttttgcagaagtggaatgtgaat

SEQ ID NO: 9047 - DNA, 430 bp, Homo sapiens
cagcgaaggaatcacttgcgaacgcccgctctctctgccatacgagtgtcgttctgcggggccatctggctggcagcagctctcagccaatggcaggatgttgtaaacctcactcgctgaatgcggcaccgaaaatcttgaaaattaactgcaaaaataaaatcaaagctggctccgagatggtatttcttggcctggcataagctctccggatgaacttgctctgccttgttgatagatgcctcttactagtttggttttttcccaggagccagttggcatcttttaacttttccttgtaaaatccaggcagaaacattttgagagctttctggagtttttatttgctaattaaaatgtgagaagggaacacagccacaggtagaggtctagtgcaagccacagctgtgattcagaagaagaaaaaaaa

SEQ ID NO: 9048 - DNA, 299 bp, Homo sapiens
gccgggcgcggtggcgcgtgcctgtagtcccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaa

SEQ ID NO: 9049 - DNA, 978 bp, Homo sapiens
gagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactaactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaataactaactaactaactaactaactaactaa

SEQ ID NO: 9050 - DNA, 3013 bp, Homo sapiens
gagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaa

SEQ ID NO: 9051 - DNA, 2830 bp, Homo sapiens
gagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaa

SEQ ID NO: 9052 - DNA, 2846 bp, Homo sapiens
gagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaa

SEQ ID NO: 9053 - DNA, 3069 bp, Homo sapiens
gagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaagtggaacgtgccggtagattcttgttggaatgccggatctccattcgactgaacatcttgctttctaggctgatcacccccagtggactgctagtgcgctgttagccatgacctcggttggccctgctcgcacccttgatgtcctcgtctcgctgaatgcgtgcatgagcgccatactccagatatctatatgaccacgtgcctcggagggtttcttcgacctgctggacctgttcggtgggcctactagggtgcacttgctgatgcatgaatgaagccttatgctgaatgcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaa

SEQ ID NO: 9054 - DNA, 2959 bp, Homo sapiens
gagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaaatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaa

SEQ ID NO: 9055 - DNA, 2386 bp, Homo sapiens
gagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaaggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaa

SEQ ID NO: 9056 - DNA, 3165 bp, Homo sapiens
gagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaacatttgaaaattattttggttttttgttcaagaaaacaaaactattattgtgatggcatttgcagaagctcagtaaacactatatacctgaataacacccaaataagctttaaaaaaataaaattaagtaattttaaagttaaaaaacaatg

SEQ ID NO: 9057 - DNA, 2990 bp, Homo sapiens
  misc_feature (2725)..(2725): n is a, c, g, or t
  misc_feature (2757)..(2757): n is a, c, g, or t
gagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacggtgtcacccccaaccacagtgccttttccatgcacgccctgctggtcaaccactacatgaaaggaggcttttatccccgagggggttccagtgaaattgccttccacaccatccctgtgattcagcgggctgggggcgctgtcctcacaaaggccactgtgcagagtgtgttgctggactcagctgggaaagcctgtggtgtcagtgtgaagaaggggcatgagctggtgaacatctattgccccatcgtggtctccaacgcaggactgttcaacacctatgaacacctactgccggggaacgcccgctgcctgccaggtgtgaagcagcaactggggacggtgcggcccggcttaggcatgacctctgttttcatctgcctgcgaggcaccaaggaagacctgcatctgccgtccaccaactactatgtttactatgacacggacatggaccaggcgatggagcgctacgtctccatgcccagggaagaggctgcggaacacatccctcttctcttcttcgctttcccatcagccaaagatccgacctgggaggaccgattcccaggccggtccaccatgatcatgctcatacccactgcctacgagtggtttgaggagtggcaggcggagctgaagggaaagcggggcagtgactatgagaccttcaaaaactcctttgtggaagcctctatgtcagtggtcctgaaactgttcccacagctggaggggaaggtggagagtgtgactgcaggatccccactcaccaaccagttctatctggctgctccccgaggtgcctgctacggggctgaccatgacctgggccgcctgcacccttgtgtgatggcctccttgagggcccagagccccatccccaacctctatctgacaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcaggtgagatctttacgccttttataacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaaggtgcctgctacggggctgaccatgncctgggccgcctgcacccttgtgtgatggccncctaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaa

SEQ ID NO: 9058 - DNA, 952 bp, Homo sapiens
tgttataaaaggcgtaaagatctcacatgccatccctactaataggatattgacttggatagcttgatgtctcatgacgagcggcgctctgcatccctcacccatgcctcctaactcagtgatcaaagcgaatattccatctgtggatagaacccctggcagtgttgtcagctcaacctggtgggttcagttctgtcctgaggcttctgctctcattcatttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagatgatcatatccaattcatatggaagtcccgggtctgtcttccttatcatcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaa

SEQ ID NO: 9059 - DNA, 478 bp, Homo sapiens
ctagaggatcccctcacccacaatccccctcggggtggcagctggttctcaatgtgccagcagggactcagtacctgagcctcaatcaagccttatccaccaaatacacagggaagggtgatgcagggaagggtgacatcaggagtcagggcatggactggtaagatgaatactttgctgggctgaagcaggctgcagggcattccagccaagggcacagcaggggacagtgcagggaggtgtggggtaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaa

SEQ ID NO: 9060 - DNA, 1182 bp, Homo sapiens
gagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagcctggctgaggtcctgcagcagctgggggcctcctctgagctccaggcagtactcagctacatcttccccacttacgcatccctgtgattcagcgggctgggggcgctgtcctcacaaaggccactgtgcagagtgtgttgctggactcagctgggaaagcctgtggtgtcagtgtgaagaaggggcatgagctgaagggagggaagtcacatcagaaaagggaaagccacggaatgtgtgtgaagcccagaaatggcatttgcagttaattagcacatgtgagggttagacaggtaggtgaatgcaagctcaaggtttggaaaaatgacttttcagttatgtctttggtatcagacatacgaaaggtctctttgtagttcgtgttaatgtaacattaataaatttattgattccattgctttaa

SEQ ID NO: 9061 - DNA, 814 bp, Homo sapiens
gagctgtcccatttacccgacccgacgccggcgtgatgtggcttccgctggtgctgctcctggctgtgctgctgctggccgtcctctgcaaagtttacttgggactattctctggcagctccccgaatcctttctccgaagatgtcaaacggcccccagcgcccctggtaactgacaaggaggccaggaagaaggttctcaaacaagctttttcagccaaccaagtgccggagaagctggatgtggtggtaattggcagtggctttgggggcctggctgcagctgcaattctagctaaagctggcaagcgagtcctggtgctggaacaacataccaaggcagggggctgctgtcatacctttggaaagaatggccttgaatttgacacaggaatccattacattgggcgtatggaagagggcagcattggccgttttatcttggaccagatcactgaagggcagctggactgggctcccctgtcctctccttttgacatcatggtactggaagggcccaatggccgaaaggagtaccccatgtacagtggagagaaagcctacattcagggcctcaaggagaagtttccacaggaggaagctatcattgacaagtatataaagctggttaaggtggtatccagtggagcccctcatgccatcctgttgaaattcctcccattgcccgtggttcagctcctcgacaggtgtgggctgctgactcgtttctctccattccttcaagcatccacccagagtgtgtccctgactcacttgggaaaccctgtgtgtcagtgtgaagaagggcgccatga

SEQ ID NO: 9062 - DNA, 396 bp, Homo sapiens
ccccaccctcccctgggcctgcctgggtgcacgctcaggggcctctgctcttgcctcctaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttccttgcacgtataaagcactctaatttggttctgatgcctgaagagaggcctagtttaaatcacaattccgaatctggggcaatggaatcactgcttccagctggggcagg

SEQ ID NO: 9063 - DNA, 1082 bp, Homo sapiens
tctgtttgtggtccggccttcttttgtgtgtgcgtgtgatgcatctttagatttttttcccccaccaggtggtttttgacactctctgagaggaccggagtggaagatgggtgggttaggggaagggagaagcattaggaggggattaaaatcgatcatcgtggctcccatccctttcccgggaacaggaacacactaccagccagagagaggagaatgacagtttgtcaagacatatttccttttgctttccagagaaatttcattttaatttctaagtaatgatttctgctgttatgaaagcaaagagaaaggatggaggcaaaataaaaaaaaatcacgtttcaagaaatgttaagctcttcttggaacaagccccaccttgctttccttgtgtagggcaaacccgctgtcccccgcgcgcctgggtggtcaggctgagggatttctacctcacactgtgcatttgcacagcagatagaaagacttgtttatattaaacagcttatttatgtatcaatattagttggaaggaccaggcgcagagcctctctctgtgacatgtgactctgtcaattgaagacaggacattaaaagagagcgagagagagaaacagttcagattactgcacatgtggataaaaacaaaaacaaaaaaaaggagtggttcaaaatgccatttttgcacagtgttaggaattacaaaatccacagaagatgttacttgcacaaaaagaaattaaatattttttaaagggagaggggctgggcagatcttaaataaaattcaaactctacttctgttgtctagtatgttattgagctaatgattcattgggaaaatacctttttatactcctttatcatggtactgtaactgtatccatattataaatataattatcttaaggattttttatttttttttatgtccaagtgcccacgtgaatttgctggtgaaagttagcacttgtgtgtaaattctacttcctcttgtgtgttttaccaagtatttatactctggtgcaactaactactgtgtgaggaattggtccatgtgcaataaataccaatgaagcaca

SEQ ID NO: 9064 - DNA, 3148 bp, Homo sapiens
  misc_feature (1371)..(1372): n is a, c, g, or t
  misc_feature (2079)..(2081): n is a, c, g, or t
  misc_feature (2086)..(2086): n is a, c, g, or t
  misc_feature (2109)..(2109): n is a, c, g, or t
tctgtttgtggtccggccttcttttgtgtgtgcgtgtgatgcatctttagatttttttcccccaccaggtggtttttgacactctctgagaggaccggagtggaagatgggtgggttaggggaagggagaagcattaggaggggattaaaatcgatcatcgtggctcccatccctttcccgggaacaggaacacactaccagccagagagaggagaatgacagtttgtcaagacatatttccttttgctttccagagaaatttcattttaatttctaagtaatgatttctgctgttatgaaagcaaagagaaaggatggaggcaaaataaaaaaaaatcacgtttcaagaaatgttaagctcttcttggaacaagccccaccttgctttccttgtgtagggcaaacccgctgtcccccgcgcgcctgggtggtcaggctgagggatttctacctcacactgtgcatttgcacagcagatagaaagacttgtttatattaaacagcttatttatgtatcaatattagttggaaggaccaggcgcagagcctctctctgtgacatgtgactctgtcaattgaagacaggacattaaaagagagcgagagagagaaacagttcagattactgcacatgtggataaaaacaaaaacaaaaaaaaggagtggttcaaaatgccatttttgcacagtgttaggaattacaaaatccacagaagatgttacttgcacaaaaagaaattaaatattttttaaagggagaggggctgggcagatcttaaataaaattcaaactctacttctgttgtctagtatgttattgagctaatgattcattgggaaaatacctttttatactcctttatcatggtactgtaactgtatccatattataaatataattatcttaaggattttttatttttttttatgtccaagtgcccacgtgaatttgctggtgaaagttagcacttgtgtgtaaattctacttcctcttgtgtgttttaccaagtatttatactctggtgcaactaactactgtgtgaggaattggtccatgtgcaataaataccaatgaagcacaatcaagattatgtactgtgtgtctgtaaagggtcagtgacaatgaaaaagacagcttgttttgttcaaaatatagactggatttcccatagagctcttttaataggtttccatgactcaataacatagcaaaatgcctccagacctaaataaggtgtttacctactgagagctacagatttaccctacattttcacagccggattcaaggtgttctagactacttgtaggcactttcaagatcccatctgctgcacttgactgaagaagtgacctttgtgattgcgtanntcctaaaaaaaaaaaaaaaaaaaaaaaagtgacgcggtcatttaactcagctgcaacttttcacggaaatgcaggaaagactaactcattgaatgatcagttgcctacttggaatgcaataagtggcttccacagcttatttttgttttccaatagaaaatcacagcctgcggatgatcagtgtgtgcagatttctccagaggctgtttagaatgaaaaatgctttcatggttaagcaaaaatgtataaaagggcttctgaagtaaatttttttctcttatgtagttaaatagatcattttgccagaagttctgggtggacagatcataggtaaaagcaagtgtgaaaggatttaagtttccaacaaaattacagcacccaaaggatggggtatttttcataaagttatttcctaaaggaagggatagtgcaattctgtcctgagattaattttacattctccaaaatacatttaaagttcttactatatttttaaataagctttttatttcatgaccatacagtaaagaaaccaaagtaaagaatattaacttctggcttatgctgcactttaaatgagcggagtattctttaacagggaaaagttgagactgaatattcttttttgcaatggcatattctaaagacaaggcaaccatcttctgagaaaggttaatgacgtagatgttttagagaccagcagaagnnngcatnaacagtaacagcctcaacaaaanctgctatgaagtttaacccctttccagcaaaaaaaaaaaaaaaaaaaggaaaaggaaaaaggagagcttctttaagaatacaaagataaatacttaaacatattttgaagaacataaaatcagtctcaggatgaaatgtcactataatttccctaggaaccaaatatggttaatatccatccacccccgaccatgagtatgtaagatgcattttcttaggggttttgtccttctttgtttgaaattactagacactgaagtaccaggtaaatgcttcactttcttggtttcctgtttatttacttattttgtctagataagtcttcacatttaaataaaaagaaatcttcccagcccaaaacatatacgcaggcccttcaaatctcaggtcttaaaatcactcaggtcttaaaatcatgaaagtcctttaagctttaagaacaaatgtgtataatttaactacttagtacacaggtttagtcactttagtgagttagaggaaaccactgtaatcttggggccggtttctatgtattggcaggaaatagaaaagatttttgtgtgatctcccaagatctccaactgaaaattacatggattcagaaacagaccatgtcagtgattccaaatccccatgaagactactttttgtcgcttttgaagaaggcagccattgatttataataggaaatgtggggagctgggctgtcagtcccagtagcgatggcagtgggaggagagagcagccagtcctgcttaatctggtgagattgtgcactgcagaaataggaagaagaagacattgagtgtgcaaaaaggcagccttacccatgggcttgtgtgtatcaaagtaccaaaagcataaaccttaaaatcaaagcaggaaaatgtgatcaagatccatagatttgctacattggacgttacattcaggttaaacactaacaataactcaatggagattttccaggatttataaattctctctccgatgtagaaatgtgtaattggtatagcatatggcttcatactttggtga

SEQ ID NO: 9065 - DNA, 1363 bp, Homo sapiens
tctgtttgtggtccggccttcttttgtgtgtgcgtgtgatgcatctttagatttttttcccccaccaggtggtttttgacactctctgagaggaccggagtggaagatgggtgggttaggggaagggagaagcattaggaggggattaaaatcgatcatcgtggctcccatccctttcccgggaacaggaacacactaccagccagagagaggagaatgacagtttgtcaagacatatttccttttgctttccagagaaatttcattttaatttctaagtaatgatttctgctgttatgaaagcaaagagaaaggatggaggcaaaataaaaaaaaatcacgtttcaagaaatgttaagctcttcttggaacaagccccaccttgctttccttgtgtagggcaaacccgctgtcccccgcgcgcctgggtggtcaggctgagggatttctacctcacactgtgcatttgcacagcagatagaaagacttgtttatattaaacagcttatttatgtatcaatattagttggaaggaccaggcgcagagcctctctctgtgacatgtgactctgtcaattgaagacaggacattaaaagagagcgagagagagaaacagttcagattactgcacatgtggataaaaacaaaaacaaaaaaaaggagtggttcaaaatgccatttttgcacagtgttaggaattacaaaatccacagaagatgttacttgcacaaaaagaaattaaatattttttaaagggagaggggctgggcagatcttaaataaaattcaaactctacttctgttgtctagtatgttattgagctaatgattcattgggaaaatacctttttatactcctttatcatggtactgtaactgtatccatattataaatataattatcttaaggattttttatttttttttatgtccaagtgcccacgtgaatttgctggtgaaagttagcacttgtgtgtaaattctacttcctcttgtgtgttttaccaagtatttatactctggtgcaactaactactgtgtgaggaattggtccatgtgcaataaataccaatgaagcacaatcaagattatgtactgtgtgtctgtaaagggtcagtgacaatgaaaaagacagcttgttttgttcaaaatatagactggatttcccatagagctcttttaataggtttccatgactcaataacatagcaaaatgcctccagacctaaataaggtgtttacctactgagagctacagatttaccctacattttcacagccggattcaatcttaccctacctacctcacagggctgttgtgaggacccagcgcgtttggatgtggaagtaaaagtgctgcta

SEQ ID NO: 9066 - DNA, 909 bp, Homo sapiens
aaatttctagagttttatttcctggccctaggatctttgactatactacttaaatttgtgggggaaccttggggatcaagtgataggtttgcgaaggtgctttggaacttcttgaatgtgctgaacatatttagcaatgtgctttctctgattgttctgttttcgtctttttttgtcctatttttttcttttagtcttattgttagggccccatcacatgttgctagttctgaaaatgcagtcaatctccttttagggagaactttcagataacgagattttctccctgtttcatataagaagttcctttcctctctcccgccctcctccctctctttctttttctttcccttcctcccttccttttcattcctttcttttttcctttccgttcttttttgggtaggggtttctggtagaaactggaaaacctgctagacaaattctaaaagctatataatgctagaatttttcttatatatcttgtaatttcctaactttggtcctccttttatctttagtattttagtccaaccttctagaatggggcttagtaaagctctgaagtctaatacctgtattctaatactgttttcatctgaatatgtgtagttagtatggttcttactgagtatggaacaattagaactgtgatattttctgtgctgtacttttttctggagacgagctggctagcagatgtgaaccactggcattggtgtcttaggggccaccactagcctatgcaccatcactatgagagctttgctctggtcaggtgatggtgtgaagtgggtgctgggtaattgcttggacaggccctgcaggtgtgggtgcaggtaaggaagatgggaataaagcagccactgagccctataaatgtctcccacatggtactctttatctcaa

SEQ ID NO: 9067 - DNA, 823 bp, Homo sapiens
ccttgactctgggtgggctgtgtgacttttccttgctcaatagaatgagaaggaggtggcgcaccggctacaaggctagaccgggggctcgcatatctccacttgcagctgccactgccattagaagaacttgctcagccagctcctgggccccaggaaaaggacaagtgtcacccagaacagagccacctccagctgcactcagctccagaagctggcccggccggtccagtacaccttttaaataatgtcctctacgtgccggtgtggaagtagcccggatgcaattgaatgaacaacagacggtgctttccaggacggcgctgtgctttccaggatggtgctgtgctttcattcatttgggtagctcctctgtgagcctcccagcgccgactgcagagcccccactctccagcctgcaagaccccgaaattcaagccacacaaagaaaggaggagggggccgttggcatttactgaaccttataaaactgtcagcaaaacagcccttaggcttggactccctgctagccgggttttacggtgctgaagtcagcatcttgattcagctgcataaataatctcctgcagtcctgcaaggcctggggtaggagagggtatggggaccagggcactctgtaagggctgggataggaaccccagggaataagacagaccaactgcgggacttcagactccactgcagccgggatcgggttgttgttaatttcttaagcaatttctaaattctgtattgactctctcatgcatgtaactgatccttagatattgtcagccaaatgactaaaggatttagaaatctg

SEQ ID NO: 9068 - DNA, 529 bp, Homo sapiens
caggaaaaggacaagtgtcacccagaacagagccacctccagctgcactcagctccagaagctggcccggccggtccagtacacgtgagaataaattgttgttgcttttacccattaggttttggggtgatttgtgatgttgcattgttgcagcaataacaaataaatataaacagtgtttgagctgtgggctccaatggacttttgtcacttattagctctggccattatttcaactttctaaatcacaatatctgtcacaaagacagcaaaataaaaatacctaaagtaatattttagaaggtgcatgcatttctgtgtgctaattaaatgagataatgctggtaagggcgttctgcagcacctggcgccagttgtattacattagcccttgtgtggtggccctgtgcctgggaagggattctgcaggcagaggcctctgcatcgggtgctgaccacagccctgtgcccaccagctggttccgtagttttcagattttacaggttaaacgtgctgaaagcagcacgg

SEQ ID NO: 9069 - DNA, 357 bp, Homo sapiens
tggcatttactgaaccttataaaactgtcagcaaaacagcccttaggcttggactccctgctagccgggttttacggtgctgaagtcagcatcttgattcagctgcataaataatctcctgcagtcctgcaaggcctggggtaggagagggtatggggaccagggcactctgtaagggctgggataggaaccccagggaataagacagaccaactgcgggacttcagactccactgcagccgggatcgggttgttgttaatttcttaagcaatttctaaattctgtattgactctctcatgcatgtaactgatccttagatattgtcagccaaatgactaaaggatttagaaatctg

SEQ ID NO: 9070 - DNA, 386 bp, Homo sapiens
ctttattaagtcagaaatttttcactgattttgactcatccagtactcttattaaaattagtaatgaagctatttgtattgagtttgtagttaatagccctaaaagggagctgatatgaatatattaggttggaacttactcctcaaatgttgatgtaatagctaacctgactgaataaaagagaaaatgtgtagtgtggagatttttttaaaaatctattattgtcttgctgaggttcctccaaaaaaaaaagtctgagaccgggtgtggtggctcacgcctgtaatcccagcattttaggaggccaaggcaggtggatcatgaggtcaggagatcgagaccatcctggctaacacagtgaaaccccgtctctactaaaaataca

SEQ ID NO: 9071 - DNA, 965 bp, Homo sapiens
gaaggagctaggagaagaattctctcatgtcagtagccctcttagggactacttaggttcggatccatttagtaactgaactcctagtgagcttgtttgcaaatcctctctattgtcccagccgtgaagtacttctctggcttccatagttaccttctccctggctggtgaagaagtggcccatgtttctggggtttcccagaatgttacagtcagcctcaaagcccatgtggaaggtatatttcctggtttctattgcaaaagttctgtagtggtgttgctgcaatgaaatggaagtccaaggcattccctgttagtgacggagtgttcagaggacctacacgtaattgctttcatgttcgttacccaagtaggggacagagagagaggagccactgacacgtgaacccagggagacctcccctggatggctgggtgcaggtacttaccacccaccaaccgatgatgagtatctgccaatttactggaagaaaacctgaaatctagctgtggagccaagatagatgcagaagaaagcgagtggaacaggagaaagtgtataggaactcagaggctggcagggccttcctgagtctgggaagggctgaggcgggaacgaggacacatttgctccctgggacacgtggttcttagtgtgcaggggaaacccgcatgtggtcactgagggagaggcacaggcccacacatctcatcaccatgaaggaaggaacaattcaatgtggccaatttgtttttctactatggcaagcactttttttcctttaacatttttggtattttaagagtttttgcacatttattctgcttctaatgaagttttaattgtttctctttcctcctgagtttagaatctgattcataatgtacatgggaacccatgaatttcactcatatttaatgcataaccaaagatataaactgaaatgatacattttgagaagatc

SEQ ID NO: 9072 - DNA, 2237 bp, Homo sapiens
  misc_feature (1545)..(1545): n is a, c, g, or t
  misc_feature (1674)..(1674): n is a, c, g, or t
caaatgtttataaaatgactaccgtatgctaggcagagtatggagcatagcaactatgaaatctgtttcagtagcttggtccagaaccctcagtatttggaaagttgcatattgtcatcatttactcccattttgattatattaagaaagtatgtgagggcatgagcctctcaggaggggacctcagtgtttccggatccctcctgccctctgtgggacctagatgctggctagctgagcaccgtcaatgtgtcctcgcagaagacgaagcgcatttcctttcttctcttttttgcggttccagtgtgatgacatggcttggtcaccatgcttcgtgtttgctaaaaagaaaccagggatatgagtttctgaattctcaacctggtgcctttgccagagaacaaagtcaggttaatcagacgtcttcccctctccagcccaactcattcgctggctgacctctcctggtcccatggttctaagaaccatctccacgataatgattcccaaatgaatatcctagcccagacctctccctcccactccagacttctgcttggattccgtgggctgtctcataggcatcttatgcttgctacatctaagtccagcaccagattccaccctccagcctgctcagcccttgcctcctgcttttgggaaacggcacatcgctttttccttgagttgtgtgtgccagaagtcgtgaactcacccttgactccatcttcctttcaggagctcagttcatcatcaggtcctctttgttccactttcaaaatgtgcagaacacatctctttcttccttccaccaggctgttttccatgtggcagccaggtgaattcctttaaaatgtaacttagttatctcatccctgttagcttagaaaggctcagtgttgcttcctacttcattcagtaaaaaatccagagttcttactatgacctgcacacttccaaatctgtcccccaaccagcataacccttattcctattccccccaaccccatacgcacagagtgtgcttcagccacgtcggtcacctttttgttcctctccaatcccactgagggcctttggccttgccgctgcctctgcctggaatagtcctctgtcacatgtcttcatggtatgctctcactatcttctttctgaacaaatgccttattgcagcagccttcagggaccacttgaacaccccatcctttgtccttccttgtaccccttatctgctgtattttgttttcactgcattgacacattatgcatttatgtctctctcccaccgccttgcacacacatactagaatgccagctccctgggtgcagagacagagcatttgttcacagaaacaaccccagagcctggagagggcctggcacaaagttgccgaatcatctgtatcctcatgggtttgctcccaggagctcagagatcgcctctttggaaaagttgcggcagggaggccagaatgagccaagcgtaacccagtcacacccgtagctcgtccttagtagaagctaagaatccagggcaggtctganagcacattcacagggtgctctgaggcttctaaacagctgtccacataggcactaacttggtatatcctcctgacaaccctatgactgaagcagcatcttcatgagagatgctttcgatgggagaggttnagtaacttgtctgaggtctcttggccgtaaagggacaatattgcaccagcagccacatgcctgaccatttatgtagcttctgactagcactaaatttctttaaggtctgatttatctctaacatgcttgtaaattttgcataatttttactccataattctggtacatgtttgttttaatataaaaataacagttgatcctaccagcttactcactccacttttttgcttcttgggctaaaagtgacacaccaataagattgcatcctggctgggcgcggtggctcacacctgtaaccccagcactttgggaggccgaggcgggtggatcacaaggtccggagttcaagaccagcctggccaacatggagaaactctgtctctactaaaaatacaaaaattatttgggcatggtggtgcatgcctgtaatcccagctacttgggaggctgaggaaggagaattgcttgaactggggcccaggaggcagaggtagaagtgagccaagattgcgccactgcactccagcctgggcaacagagcgagactctatctcaaaaaaaaa

SEQ ID NO: 9073 - DNA, 414 bp, Homo sapiens
gacatgccagaagtaaaggtcagtgaacttgaagatagattaatagaaattacccaagctgaagaacaaagagaagactgaaagaaaaatggactgttgtttggtttcctgtgagactataccaagcaatctaaatccagaaataaagaaaagatagaataagtcagaaaaaattgaaaaataatggtgaaaattttccacatttgattaaaaacattaaccttcagaattaagagatttagaaaaaatacatgccaggtaaaaacaaacgcactgaaaaccaaatataagaagacaagtttaagagcagccataggaggaaaataagacaaattatatatagtagtattataaaaacaaatgatggctgatttctcatcagaaagaaaaaatggatgctatatttaaagtact

SEQ ID NO: 9074 - DNA, 2284 bp, Homo sapiens
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 9075 - DNA, 2262 bp, Homo sapiens
gggacttgaaaaactggagcctgttcttggcaagaagattctaatgcccaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 9076 - DNA, 1938 bp, Homo sapiens
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 9077 - DNA, 2226 bp, Homo sapiens
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccaggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 9078 - DNA, 2078 bp, Homo sapiens
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccacagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 9079 - DNA, 1845 bp, Homo sapiens
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtgggggcccgtctccccaatggtaaaaaactctttgcggtctcgcgttacttattagctttgttttgcctccacattcgaggagagtcttgtatttattatgttttaatcaggtcaccatgggcatttttcccagggtctct

SEQ ID NO: 9080 - DNA, 889 bp, Homo sapiens
agcagttgcctactttccccgcagtgcgataaacccctcgttggggccgccttagttctcggccgctctcggaggatggcgatctgggagcccctccatgggacccctctcacactttgtcactggaattttatttattttttagttcatattttattttgcttatagaagagaaagatatcccttccgaagaggaggaagcttacagaagtttataacctttcaaaaagtaaataagtccaggcttgcctgattctgccctacccggacttccttatcccgtctgtgggagacccaggtgctttctcattactcttcagaaggaaaccgctttggagttcgtgtaattgggacttggggatcagggagaagttgccgaaacttctcataccagtaactactgaagtagaagattctggaaaaatccttgtcttgggggcacaggctaaaacctgaaggatttttaagatgaccaaggttccagccaccaagaagcttcagagttcccccaactcgggggctgtccggcccttttatgcctcggagaacctaaggcaggtcccagacaagccaatgaagagcatcaagtatatggacaaggaaataataaacctcaaaaaggaccttatacgaagccgcctctcccactgccggacacaaaggagaatggggaaaaggccaaacagagaagccacaagcaagcaagaaagaaacgacaatgagatgttccatctggccacacttctggatcccaccaacattaaggaaggaatcaggattccccttcagaaggaaacaccatgttttccaagggaagtcatctctccaagtggcacaaactccctgaccccatatcccagtattaaatgaggcgaattgttaacaaaga

SEQ ID NO: 9081 - DNA, 948 bp, Homo sapiens
agcagttgcctactttccccgcagtgcgataaacccctcgttggggccgccttagttctcggccgctctcggaggatggcgatctgggagcccctccatgggacccctctcacactttgtcactggaattttatttattttttagttcatattttattttgcttatagaagagaaagatatcccttccgaagaggaggaagcttacagaagtttataacctttcaaaaagtaaataagtccaggcttgcctgattctgccctacccggacttccttatcccgtctgtgggagacccaggtgctttctcattactcttcagaaggaaaccgctttggagttcgtgtaattgggacttggggatcagggagaagttgccgaaacttctcataccagtaactactgaagtagaagattctggaaaaatccttgtcttgggggcacaggctaaaacctgaaggatttttaagatgaccaaggttccagccaccaagaagcttcagagttcccccaactcgggggctgtccggcccttttatgcctcggagaacctaaggcaggtcccagacaagccaatgaagagcatcaagtatatggacaaggaaataataaacctcaaaaaggaccttatacgaagccgatgcagtgagaggcaaagtgagacaccctctcccttcacctccatcttctgaaagccacccttctccaccactaccggaatctccaccctgccccatccagcagcacaacttcatggaactgatgactgagcccaggaggactcctggaagggtagctgcctgggtgctgacaggtggcaggaagtcacagtggctaagaaactggctcctgagaatcgcctgaacccgggaggtggaggttgcagtgagctgagatcgcgccattgcactccagcatgggcaacaagtgaaactctgtctcaaaagaaa

SEQ ID NO: 9082 - DNA, 462 bp, Homo sapiens
caacctgtgcctccttgaaactggtagagaaactgggatcagtattgggacacccagagctgatatgtgaggaattattggcatgatctacaaatgtgtgaaatttgaggattttataagccatttcagtcatatcagtgtttattaactacataggttaatattttgtgtaggtcatttttgtttatactgtagtcttcagtagcttaatggtgggaagcttacatctggaagcttttggggctcctgcacctagccaggttcagtcattgtgattctgtaacttcaccagaactcaaatttcttgggaggttttgaggaccacaaaaattaacttgagtccaggtgtggtggctcacacctgtaatgctagcactttgggaggccaaggcaggctgatcacctgaggtcagaagttcgagaccagcctggccaacatggtgaaaccttgtctctactaaa

SEQ ID NO: 9083 - DNA, 1760 bp, Homo sapiens
ctgcgagagggagggaggaaagggctgtgcaataaagtcctctcccattatcttactcaacacaatttattgagcaaatactacgtgttctaggccctgtacaggccatctcacttgatggccacaacagtcctgggaagcagacaaaccaagaatgctaatgcccatctgacatcagagacggcagtgctccccagacctctcacagcaagctggatggacaggcagggccagaagagtcctccagccaagcctcctccttggttcttgtacccaaaggtagagaaactgcaggtcttcttgggtctgagcctggggcaggggttctggctggacgaaaaggggcagggaagcagcaggagccagagaccacaggctgagctggagcccacatggttcctaagggcagaacaggctctgaggaaagatgtgaacagctggaaggctgacagtgaggtctcagcagtgtggtgcacccctccccagcacatccgagtccctggggtcccaggtaccataggtactgcaagatttcccaagagacagcaccagcaacctgggcctgaccctgtacaaccgccaaaccatcacgagccccgcccaggcttgtgagaaggacatgcatggatcaagaccttgcccttgacccatctgcttctcagatgggctcccaatcaccagaggaagttgctgtcagcccactttccagactgcccccacactggggctctaagtttcaggtctgagattttatgctctgtgatcccccacttggggttcccagactccaagctcctggctcctgtgttcagtggctgaattcaacgtccgagattcggaatatgggctccagcctgcagaaactcttctccaggcattgtggtttgtgcctcctagtgttggctccctcatgaaaagagggtcaacacccttggcccccagccaagatctctgctcaatgtccatacaaggaggaagccaaaaccaagtgaggtgctggagccacattcaaatgtggttgataatcttggggcaggccagctctgatgtggatgaaagctgagccaactgtcgccacagctgcccagctgggtccgctgctcccctggctggctgttcagctgtctactaagcccaaaaaaaatactatgcctcactagcagaggctagacccagaaagagggaacaatgaggacccctcccctcccagaggaaagagctgagccactctccccatccagggaacagtaggtccaggctggatgctggtatgatgggaactgcccttttcacctgccagggagttcctaaagctgatcttcctggggttctgaaggttgcgacctaggttaatgagaccaaattctaggaaccactgcccaggccaaccaccgccagtgctgcagagatcaaagaaatccacagccacaggaaaaggagcttctttggacatgcccagctccaaactgtcccagggggaactggcacagcccttacatagcccaccccctcttggcctcaccgtggcctggaaattggccagagggtccacatcctgcccaaaccactctcctctcgtcccaaggcaaaggtgatgccctgaggcctagggctggataaagcccagctctggatgctgctaacccactctgctgccccaccccatcctccaatttttatactaggctctttgccattgtgacgtcccatgacatagtctgatgcacgataaaacaattatttctttatcttgcaattgt

SEQ ID NO: 9084 - DNA, 795 bp, Homo sapiens
ttactgaatcaaatttgtctaggtattttcaaaacttttaagatgaataccacatactttgctgctatcaaaatctgttttaggaaaccaataaataatagtttgaaggaattatttgggactatttttattacaccttttgatagcattgctctgacctttgtgtttattttgcttgagtttaagttgagtttattttgcttaagtttggtataaccaaacttatttgtgggttctgtacatacagaaatgaggaattatgtagagattttttaaaaccacaggctttatgtggaacaataattctgacttgaaggttagaactgaataccacaagttaattaaatattttttgtattttattgtgtaaaatatgatcgattctaggagccactaccaatgagaaagaaccagttgttttgttcttgggctataaaaacttgttccagcctcttttttgtcacatgtcctccctatattcctaaactgcttgttgtttttattctgaggccgctgaagtcttttcttgaacttggagtaccttattctagtacatctcaaaactgaaaaaaaaaaaatagatctttatagaattttgctttctttcactttttaataattaacatatattcattattttaaagaagggtagacatcaaatttcacttgtgacgtatcaagactgaaattgttaagtatgtaaaattatattttacctttaatggtataagtattatatgaatatttttctctattcttattggttttgcaatataaagaacagtttaatcacag

SEQ ID NO: 9085 - DNA, 127 bp, Homo sapiens
ttttggatcttcagtgacccaagcaagctaagcacactaaaaggaaataggaggagagaggtggattttgaaactcatccttggagctctgagaaaactagggatgttttggcagagagctatactg

SEQ ID NO: 9086 - DNA, 282 bp, Homo sapiens
cccccaggcaaattttgataagatacttgtgtcaatacaaaaagagattaatgccaatgtgaatcaatacccgcttattggtttgggttgcttcttctccacgcagcagctggcaccaagaggggtttccaaacaccagcggctcccagccaatctgcatatttctttatttaaatcatgagagtgggaagtggcaagggaatggtgggttggcagggggctgcccacgcccactcccaaattgagaagggaatgaaaataaaacaaacgcaacttgtcaac

SEQ ID NO: 9087 - DNA, 430 bp, Homo sapiens
ggcggaggttgcagtgagtcaagattggattgtgccactgcactccagtctgagtgattctgtctcaaaaaaataaaaaaataaagaagtcacaggaggcccagcatacagagaacatcaggtatagagagatgtccttcctgggccaaaacaggtggtgtcattttgctgagtttgatagagaaaaagtcctgatgtctgtgtacataagaactcacgtctagagttcgagaaaaaccggtgatgagaacttgaacttggaggagtcacagggggatcaggaaagcttggtaattggcatgaatttcctacctccaggggcctggcacagagacctaggatgaagagggggccatcgagcatggtgttgaacttggagagtgttggggagctgccccagccgagggcactggatgggaattcatgccag

SEQ ID NO: 9088 - DNA, 471 bp, Homo sapiens
gaacgggaaaagaagaatgaggatgaccaagtagaaagcatgcttttgcactgttgcgttgatcaatctggacctgaggccagcatcctggtgcctactaggcaggaggaaatcaagatgtataaaactaaggtaggccagagaaacaggaaccaatcatggtggaccataaaatgaggaagtcattggacatttagaaaaaggacaaacagagtgggcctgaaggggagattggcaaagagagtagtatactttagtgtgtaacacagcaaaacacagttacaaaatcttcttaaaatttggagacagattctgaagcatatctatcaagagaatgtttctatctcaaggtacttaaaagaatattgaaaatatttgttcttaaggtacctcaccattatcttattttagcaagcatttaaaaacagaactaccatttgactcagcaattccattactgtttatatatca

SEQ ID NO: 9089 - DNA, 887 bp, Homo sapiens
ctaaaatttgctggacaaaaattgtacctcacagttaacagtctgtttcactaacatttgtgcataaaacctatatatctgaaggaaaaaatgcctaaaagcaaagataatatgagggtagccatggggaaaacagaaattggcaccaaaatccttgaaaagtatcctaacccatgctgtttcacgtttacactttactcaatttacctttatcagaggggccagaaacaatcaattcaacttcattgaccctataatttacaaaggaatagcgtatgtattggctttggggtttctaagaaatagtaaaaggataaatagtgaattggtcacctaatcgggaaaggtggttccttggtaagatgataatttcaggtgtgaatgaccacagtgtattcctctgcccactccttcagcctcatagcctcaggcaaggtggccacttcaatagaaccctgcaaagtcagagggcctgagttcaagccctaacgcctttgtctctctgatttacccactctgacacaaggcaggcttctcacttctcagagtgtttcctcattaggagtctgataataattcagatattacctcccaagggaaaagaggaaataatatatacaacaatgctttatatagtataccttgatatccctaaatcattatatttctggatgcttttcctgaagcaaatgtttggctggactaccaaagtcagtaatttcataggcttttctcaagtatttgtcgtaactactgtcgtctccattttacctaaaacattaattttcccatgagaatacaccagaggttctataattgtactgctagacttaatttctcaccctttcccccttagtctttgaataaaacaatttctatacatttat

SEQ ID NO: 9090 - DNA, 459 bp, Homo sapiens
taagctttaaataaatactaagtatagaggcataatactgaatatctgaaatatctttctgaatttttttctttttaatatatgggttcaaggaaaatttcttagtaaataaaagttggaataaatacgtttgtcatttattatatacaggtagtagctgctgtatttttcataatcactgttagcagttgtggttaagcccctaaaatcatgtttttctctctgaaaggggtttttaggaatcagtcacccactttgtcagttctgcctggcctgatctccacgcctcatgttcctttttggggtgatcctgtgagaagcctggtgctggcaggtctgggaattcaggagggccttggagtgtgttccctacacacttcactgtgctcttccactctgatctatataagagagcaatttaatgtgaatctattttgaataaaataattaaagcaaatg

SEQ ID NO: 9091 - DNA, 306 bp, Homo sapiens
gtgtgtttgtttttcccattgtacctaaatgatctaaactcagtagcattctgtgttgactggcattttgttcctaaaagcacacactcttcttacctttgttgtaaatttttctctgttgcctaggctggagcgcagtggcataatcatagctcagtgtatcctcgaactcctgacttcaagtgatcctcctacctcagtcttccaagtagctgagactacaagcacacaccaccacacctggctaattttttaaatttttatagagatggcaacttagaccccacctcgacacaataaatacac

SEQ ID NO: 9092 - DNA, 955 bp, Homo sapiens
aagacactcctctccttctttgccccttgtctcaacatttcggagtctgaagtgtctgagacgactgtaagccaggaggggagcatttggtcggcttcccatcctggcattcctacataccagaaaagcactgtcgacggtccatttatttatttatttatgaagagcctaatgtgatgaaatgtgttgtgaaatgacatcctattagccaatatggccactccagttcatttcaccctcattttcccataccaaagtccaccttttagaagaccatgtcacatcgcctctgagagcttagctttgaagtgagctcttttgtgtcttttgatgaacgctccagggcacccaggctggtctctctgccatgccaacctcaccggatcctctcctggactgagtgagagtgacctgctgttgggtgtccaccttggagtagggtgttgtggccatgggacctcccaattcttctttctttggatgtgaacctaactctgccctctaatgatatccctgaactctgaggggaccttgggcatcactgaacctcctctagtcaagaaacaagaaaaaggaggtgctgcttcctccattcagcagatcatgcacaaattactcctagacagaggcttcccacttgaggcaaaggatctttggtccttctgggttcaggttgaacattaatgttcttctctagtgatgcctactttgcggaatacactagtgcaagtcattttggtgctaaatactgcagaaaccaacaccaacgggagagctgtcagccagcttctggggctgcacgagactcaactcagaagtagaagtgagtcagccatgccgggagagtacagggtgcattggaagttaagtagaaaagtggcagggtgaaaagaccagcaaaatttctgattttgctattagttatccacgtggccttggccaaatcagcttattt

SEQ ID NO: 9093 - DNA, 2647 bp, Homo sapiens
taccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcaggcacctacaaggttgtgccctccacctacctgccggacacagagggggccttcacagtgaccatcgcaaccaggattgacaggccatccattcacagccaggagatgctgggccagttcctccaagaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccagggggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctcca

SEQ ID NO: 9094 - DNA, 2475 bp, Homo sapiens
taccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagcctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcaggcacctacaaggttgtgccctccacctacctgccggacacagagggggccttcacagtgaccatcgcaaccaggattgacaggccatccattcacagccaggagatgctgggccagttcctccaagaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccagggggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctcca

SEQ ID NO: 9095 - DNA, 2385 bp, Homo sapiens
taccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttaggtcccagagggtggaaggagccaggacgcacccccactgctgctgcaggagccgctgctgagctgcgtgccacatcgctacgcccaggaggtgagccggctctgcctcctgcctgcaggcacctacaaggttgtgccctccacctacctgccggacacagagggggccttcacagtgaccatcgcaaccaggattgacaggccatccattcacagccaggagatgctgggccagttcctccaagaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccagggggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctcca

SEQ ID NO: 9096 - DNA, 1045 bp, Homo sapiens
taccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggtcccagagggtggaaggagccaggacgcacccccactgctgctgcaggagccgctgctgagctgcgtgccacatcgctacgcccaggaggtgagccggctctgcctcctgcctgcaggcacctacaaggttgtgccctccacctacctgccggacacagagggggccttcacagtgaccatcgcaaccaggattgacaggccatccattcacagccaggagatgctgggccagttcctccaagaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccagggggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctcca

SEQ ID NO: 9097 - DNA, 797 bp, Homo sapiens
taccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtgcggggccccttccctgtgtttgtcctggagccggtttctttttgcgtttctccagcctgctgagtaccaggaggccttgcgaaagcagagctgtgccgcagccggatctcctgctgtgttgggggaaggcaggagagttccaaggcagaggctgaggactgcactctgtccctctgctgcaggggggggtgccttggcctcgccagaaggctccatcagggaggttcgccctgctctgtgctctcctgacccccggactccatggagtcagatcaccacgtttagaataaagagacaaatgtgccagctcacaggaggacggggctggctggc

SEQ ID NO: 9098 - DNA, 531 bp, Homo sapiens
  misc_feature (1)..(1): n is a, c, g, or t
  misc_feature (11)..(11): n is a, c, g, or t
  misc_feature (24)..(25): n is a, c, g, or t
naatcgagctntgtctttttttgnncccccccccgaactgggagataaaactctgtggttttaatcttctcattttagaggctatatggatatacatccaaatgactggattttaaaatcacttggaagagtttgtgctcagtgtcctgtggtgtgaacacgcttcattcaacctgggcccttgggagagatgctgagtggttcccgggctgtccccactccacaccatggcagtgaagagctgctgaagtacatgcttcatagtccttgcgtctctctgtgagtacattcctagaagtggggttattgggtcaaagagtaaatgcatctctaatttggctaaagatattgccaaatccacctgcctgggggtttgtaccaccttagagatcagtgatcaatgggtgatatccgaggacgtctttctattgtggtcagactcttggattttgacctgactaatggaggagaaatggtgttgcagtgaacttttgatttgtgtttctctttttatgatcgttttgagcttaa

SEQ ID NO: 9099 - DNA, 2328 bp, Homo sapiens
atccaggtgtgcgttagagttctctgcagaccgcggtgcctgtggagcactcagctgtggccacaccgcggccgggacactggagtagcgccgggtggtgcttatatcacgctcgccttttgcttctccctgtgcatggcaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcaggcacctacaaggttgtgccctccacctacctgccggacacagagggggccttcacagtgaccatcgcaaccaggattgacaggccatccattcacagccaggagatgctgggccagttcctccaagaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccagggggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctcca

SEQ ID NO: 9100 - DNA, 1885 bp, Homo sapiens
cggggttgacgtctgctggtgctcccagacccggctctgacctgagactgcaggtctttctgccttgccgtgtgcctcattggccaaaggaaagcaacagagtctgcagccagggcaggacccgcaggaggggcctggacccggggggctcctggcagcgccgtgcctttctgaggcaaggaggtagagccagcggctgaggacctgtcagggccagtcccagctctgcagcttgctgtgtgacctggcacacatcctctccctgcctccctcagtctcttcccctgcaagacggggtcctgacacggatctcatgggattgctctgaggcccaggcagtcccaggctcaaccactggttcacaaagtgtgttgtttccaggaagaacagatgggggcgcctgagggcaaagggcctgagtgtgggtcgaggatatgccggctgctcgctcaggggctgggttttcatcttgtgtgtcttgacagggtgtgacacttggcaccacactgttccctgtcccttcatggatgtggcccacatgatgttcctttcctcttgcaaaagaagttgctggaaggcccactgtccagcagcccccaggttgcctgggccacggtgcctttgtgggcccagctacaaggaggacttgcaggctcgtgtctgggacagatactggcgccagggccaagtgaagcccgggattggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcaggcacctacaaggttgtgccctccacctacctgccggacacagagggggccttcacagtgaccatcgcaaccaggattgacaggccatccattcacagccaggagatgctgggccagttcctccaagaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccagggggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctcca

SEQ ID NO: 9101 - DNA, 669 bp, Homo sapiens
ccgcccatccattcgggcaataacagcttctggtgctggacatgggctcattgctccttctccaagccctctgaggacatcaaaagcgtggacgcatcactttccaccatcttgctgcccactgtccctccatcctgaggcctcctaagcacatgtgtggggtggcaggcacactgctgatagctgtggatgcggccgtgacatccttcacccctgcccccatggcatgcatgatccattagggaggaccgtctgcacaaaggtaatccattgactcagacagggggttcatagaagaacaggtgagagtggcagggggggtattccttgaccagctgagggtcagccaagggcaggaaaggggctgggcaccctcagggaattgaaagaagctctctgtgcctgcagtgcggggagtgggcttggagaatatggcaagagctgaggctggagatgtaagcaggggccttaagtgttgtttaaggagcctgagtcttatctcctgggcaattgggagccactacatagtttaaagcagggcctaacatacatatgtttgaaatctttctctggctgaagtctcgaggatgaattggaagtagaggaccaactaaaaagttgttgcacgacattaaggtggtgtcctgggttaggtgggaggtgatggag

SEQ ID NO: 9102 - DNA, 1200 bp, Homo sapiens
ccgcccatccattcgggcaataacagcttctggtgctggacatgggctcattgctccttctccaagccctctgaggacatcaaaagcgtggacgcatcactttccaccatcttgctgcccactgtccctccatcctgaggcctcctaagcacatgtgtggggtggcaggcacactgctgatagctgtggatgcggccgtgacatccttcacccctgcccccatggcatgcatgatccattagggaggaccgtctgcacaaaggtctcttgccctgtgcagcttcctgcagactggacttgcaaagtccagcctgtatggctggagttcccatgcctgccaatctcctgtcgactgcgagtcagctccgatacttcaccagattcagccacctgggggagctggaagtgaatctcatcttagctgagccttctgatgagactgcagccccagctgacacctggattgcagactcatgaaagacctgaaactctaccaacagccacctgggggagctggaagtgaatctcctcgtagctgagccttctgatgagactgcagccccggctgacacctggattgcagactcatgaaagacctgaaactctaccaacagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagagtgctcagtgtcctgtggtgtgaacacgcttcattcaacctgggcccttgggagagatgctgagtggttcccgggctgtccccactccacaccatggcagtgaagagctgctgaagtacatgcttcatagtccttgcgtctctctgtgagtacattcctagaagtggggttattgggtcaaagagtaaatgcatctctaatttggctaaagatattgccaaatccacctgcctgggggtttgtaccaccttagagatcagtgatcaatgggtgatatccgaggacgtctttctattgtggtcagactcttggattttgacctgactaatggaggagaaatggtgttgcagtgaacttttgatttgtgtttctctttttatgatcgttttgagcttaa

SEQ ID NO: 9103 - DNA, 458 bp, Homo sapiens
ctccacaggatgcatacgaggtccccgcggtcccggccgacatacctgttggggttcttagttgggcagcttcctcctccgttctctctattcccctcctaggtctcttgccctgtgcagcttcctgcagactggacttgcaaagtccagcctgtatggctggagttcccatgcctgccaatctcctgtcgactgcgagtcagctccgatacttcaccagattcaggtgagagttttggttttttgacaagcccacttcatcagcagggcatgcatttctgccagggggctcatgatatctggtggtctctttgtgaggccagcagccaccaatgatcacgaatgtggcaggaagctgccaagagaccccccagtgggtgattcctgcctcctgctgtcatgcaattccctcctgaagggtggctggacttactcacttataacaaacaatacagtaa

SEQ ID NO: 9104 - DNA, 406 bp, Homo sapiens
gctatatggatatacatccaaatgactggattttaaaatcacttggaagagtttggtaggttcatattgtcaacccataatgcaagtcagttagtttcattttgctttcaattttaagaattccttttacaagttaatttaattaaattaagtaattacacaaacatttgacatgagtctaaatccaaatctagaaaccaagatatggtcacagaagtccgtccctatccccatcccatttccacctgtttcctacaggtaacagtttaatttaaagcaaattttgtggcttatctttccatttgtaaaacatacagctgatggctccatctaaaaacacatcaattgtctatatgtacataaacatgctttttttcatttacaaatacattctggagatgaccat

SEQ ID NO: 9105 - DNA, 837 bp, Homo sapiens
attggccaaaggaaagcaacagagtctgcagccagggcaggacccgcaggaggggcctggacccggggggctcctggcagcgccgtgcctttctgaggcaaggaggtagagccagcggctgaggacctgtcagggccagtcccagctctgcagcttgctgtgtgacctggcacacatcctctccctgcctccctcagtctcttcccctgcaagacggggtcctgacacggatctcatgggattgctctgaggcccaggcagtcccaggctcaaccactggttcacaaagtgtgttgtttccaggaagaacagatgggggcgcctgagggcaaagggcctgagtgtgggtcgaggatatgccggctgctcgctcaggggctgggttttcatcttgtgtgtcttgacagggtgtgacacttggcaccacactgttccctgtcccttcatggatgtggcccacatgatgttcctttcctcttgcaaaagaagttgctggaaggcccactgtccagcagcccccaggttgcctgggccacggtgcctttgtgggcccagctacaaggaggacttgcaggctcgtgtctgggacagatactggcgccagggccaagtgaagcccgggattggtgggcatctctagctggtccctgagagagggtggagggtgctgacaggccttggcgctttcatctgtcaactccagaggcccttgtgcttgcagcagggaggtcaaggccagggcgtctgaccccggccgctcctccacactgagcctcctgcacgtgctcacaggtagagaagcggcgggtcaatctgcctagggtcctgtccatgccc

SEQ ID NO: 9106 - DNA, 2694 bp, Homo sapiens
taccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaagggtgtgacacttggcaccacactgttccctgtcccttcatggatgtggcccacatgatgttcctttcctcttgcaaaagaagttgctggaaggcccactgtccagcagcccccaggttgcctgggccacggtgcctttgtgggcccagctacaaggaggacttgcaggctcgtgtctgggacagatactggcgccagggccaagtgaagcccgggattggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagcctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcaggcacctacaaggttgtgccctccacctacctgccggacacagagggggccttcacagtgaccatcgcaaccaggattgacaggccatccattcacagccaggagatgctgggccagttcctccaagaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccagggggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctcca

SEQ ID NO: 9107 - DNA, 2182 bp, Homo sapiens
taccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtcccagagggtggaaggagccaggacgcacccccactgctgctgcaggagccgctgctgagctgcgtgccacatcgctacgcccaggaggtgagccggctctgcctcctgcctgcaggcacctacaaggttgtgccctccacctacctgccggacacagagggggccttcacagtgaccatcgcaaccaggattgacaggccatccattcacagccaggagatgctgggccagttcctccaagaggtctccgtcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccagggggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatcagtcttgctcca

SEQ ID NO: 9108 - DNA, 1315 bp, Homo sapiens
taccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtctcttgccctgtgcagcttcctgcagactggacttgcaaagtccagcctgtatggctggagttcccatgcctgccaatctcctgtcgactgcgagtcagctccgatacttcaccagattcagccacctgggggagctggaagtgaatctcatcttagctgagccttctgatgagactgcagccccagctgacacctggattgcagactcatgaaagacctgaaactctaccaacagccacctgggggagctggaagtgaatctcctcgtagctgagccttctgatgagactgcagccccggctgacacctggattgcagactcatgaaagacctgaaactctaccaacagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagaggtaatttttttgtgtagcaataggtagctgacaatgcacagctaaaataatagataattaaccctaatgctagtttcattcatccatcagggtttgcaaagtagtgatattctacttctgtcttccttcattatttattagcagaaatgtatctataaaaagaagtgttccttcattaactctttggtcatgttgaggtacagtttgcataggaaaggcagggcaaatgcttgattctttcccttcctttcctcatttataaaataatgaactgttttcctggcatctttcaacaatgactaatgagttttt

SEQ ID NO: 9109 - DNA, 2170 bp, Homo sapiens
taccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagcgccatcagggcagtggccaagaacaccacccccggggcagccctgcctgcgggggagtgggggaccgtgcagcctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcaggcacctacaaggttgtgccctccacctacctgccggacacagagggggccttcacagtgaccatcgcaaccaggattgacaggactccatatggaggcctcacacccagagggtagggcagcagatcttctttataactatttattgttcgaatcacttttaggatgtaactttataaataaacatgagcgctgatgatttgcagatcagtcttgctcca

SEQ ID NO: 9110 - DNA, 820 bp, Homo sapiens
gtagtgccccgaggggctgtgctgggcacgtgctctgcctgccgaagtgaggaggctgggcacggtgcctgggttccccctgcccaggcccagtttggttctcttcagcgtggagagatgattctgtcccaggagccgggaggagggtgatgattctgtcccaggagctgggaggagggtgggcttgtgggaggggctggctctgtctgtggccgtagctgctgcttagaccctgccagggttcatgaggccaccgtggcgggaggccagcgaggagccgtgtcccacagctgatgcctggtgttttctcactagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtaactcagccccgtctggctcacgctcggttcagcaggtggtgtggaggcccatggaggtctgggttctaggactggctctgccgggacacatgtgactctgccacgggccccaccagtctcccccctccttgggctgttgcacggggttgacgtctgctggtgctcccagacccggctctgacctgagactgcaggtctttctgccttgccgtgtgcctcat

SEQ ID NO: 9111 - DNA, 501 bp, Homo sapiens
tttccagaacaatattctttctacttagaatgtcttaacaaattttgtatattaatagttcccttcctttaatggaaaccctcatgacctgtattctgtttctctttttacgcctgacttctagaggcaagctatagcatctggtagctcccagtgattgcttcctttttggtaggctgtttgttccctgtgaccagtgaacctccctggttaaaatagacatagaaagctgacctagccaggcatggtcgtcacgcctgtaatcccagcactttgggcggatcacaaggtcaaaagatcgagaccatcctggtaaacatggtgaaaccccgtctctactaaaaatacaaaaattagctgcttgtattggcacgtgcctgtaatcccagctactcgggaggctgaggcaggagaatcgcttgaacctgggaggtggagatggcagtgagccgagattgcaccactgcgcttcagcctggcgacagagcgagactccatctc

SEQ ID NO: 9112 - DNA, 542 bp, Homo sapiens
acacacacacatttctccccaaactgtctcagcccccaggcacctactgcaaggactcggggatcgtgcagaggtgcaaaggagtcgtgccctcctcagtcagcacattagccttggctccgaaggtcagcagcagccgcacacagtcaaactgggctcgggcacaggcctcatgcaaggcagcgcgacccccgacacgggcatccagctcagctccctgccggatcaggtgtcgagcacagtctgtgtagcctcgggctgtagcgatggcgaggggtgccgtctgcttggtcttgggggtcagcacccagaaccctagggagagcaaatagttttgggaggtggtgtataagacagggcagggcagggagtggggatgctggttccagctgacagctgacactggccttccctctgcatggtttgctgagcacaaacactgccaggctgtacctgtggaagggggcttattcaagtcctgaagtggaagaataaattggaacagccttttaatacagcttatcaatctgtaacaaaacata

SEQ ID NO: 9113 - DNA, 808 bp, Homo sapiens
atttttagtagtttgagaaatatttaactggaatcaagaaagggatgagaaaattttttgttgttgcaaaatacctaattggaaggatgttttaaaatatgggtacttcacatttttattaatagaaactaaaattgaaaatttcaaggcatcttcattggggaaaagtgaacccaattacaatgaagaggacacattttaattaaaaattaaaaggtacataagacgcatttatctttatgtactcaacacgcttattggagctcctttgaaatacgtagtctataaaatacatcagatcatgtattcatatataataacattgggggtagcattcccaaggttttttttcctaaaattggctttctacattatgtaaaataaggattgtgctttgcaaagctgaagaagtgtatttatctggtgaatttctcagattctttattaggtcagtaaacaccatgaatacccagcagaatgcaatgtttcctcaacttatttgaccatgaaccccttttggtttttcaaaatatctcatacgactagtgccctaaagtagaatttatattcatagttactgggagattttctccctttaaagtgtgaatctaacattatgagtcactttttctgaatatcatgtattacatgtttttgttaaattctacctccatagagtgggcatgttggctcatgcctgtaatctcagcactttgggaatccaaggcaggaggattgcttaaggccaggaacttgagacagactcagcaacatagggaaacccctgtctcaataaaaaataaaaaaa

SEQ ID NO: 9114 - DNA, 423 bp, Homo sapiens
cagtctgatatataggaagcacttaactctttatcctagaaaagatttaaggtgaccttaacatatatgtcagaaaatctttaaaattgtggaaataaaaggttgtataattctgctatcctaaaattactagtatttcaatatattttattttagtcttttcttttagatacaagttttaaaacttttaagtgaagtgtaatatacgtaagtactgcttgatgaatttaaggtgatttctaaagccaggtttgttggggaagaggagtgggatttagtgatttagaaccagaaattggggctgggtgcgatgtctcatgcctataattccagaacttcgggaggccatagtgggagaattgtttgtgccccggagttcaagaccagcctgggcaactcagtgagacgccatctctacaaaag

SEQ ID NO: 9115 - DNA, 436 bp, Homo sapiens
gcagggtcaagaaataataaatctaagtctagcgttggtgggataatgtcggtgtcactaaaagaaatggggaatttggaaggtaaagtaactggaggtaggaatgaacccaagatttactaagcaccttctgtataccaaactcaacactaggagtttatacaatctttaaaacagctctaagagtagatattataattcccttctgccaataataaataataagtgactaaggtgtttttgaagctcaagattgcttgattctgcagtcttgttttaaattttggacatggagagtttggagttctgagatgagggaaggcatctgtcatagtgagagagctgaaaacatggagctcaggacaaaagtcagtgctagagagatcagttggaagagttatctttattgtagtgagacattgaatttttcagtgga

SEQ ID NO: 9116 - DNA, 289 bp, Homo sapiens
acggttaaaaatcaatgcctgctaatgtccctgcaggaaggcagaaacatgaacttcatgaagtctccttctgtttacacgctcattaagaggataaaatgttacttgggttgggtcaggctttttgctgcctctgaggtggtcctgtatgaaaatgtgtgccttcatttgggtatggcctgtgtcacacattatatgcctatggtagttatgaaatgcaaactccacctcttgtctgtgcagtcactgagtgtcctaatatcaaagtaaaactgtgagttgaggccgg

SEQ ID NO: 9117 - DNA, 453 bp, Homo sapiens
caacagtaaccccctgccctgtcctgccagggtaagggtcacgtggcccactctgatgcccaggcctggcccttagtgggaggaggggggcacgcacctgttaagctctcaaagcttctgcttttctgtgaaaatcccaaatcagtgtccagaaagttcctggtgaggcagagaggtgagcattcttcctaggctgcaaagatcaatgggttctatgagcaagggcaacgtacagaaaacacatatggggcaggaatctgtcaggcaggtggcaaagcattgcagactacaaatgcattatgctgtatttaaactttctccctatgactagattcttcagtttctcattttcagctgttacaaacagtattgcagtgaacaatccctttccaatatcttcatgatgttacacaagtgtttttgtaaaataaaagactagatgtaaaattgatg

SEQ ID NO: 9118 - DNA, 722 bp, Homo sapiens
catgacattgagaaatttgcattaactttctgcctattactttcctcatctctaaaaactaacagtacctactatattagtccattctcacactgctatgaagaaatatctgagactgggtaatttataaagaaaagaggtttcattgactcatagttccacaaggctggggaggcctcaggaaacttacaatcatggtggaaggggaagcaaacacatccttcttcacatggtggcaggagagagatgagtgccagcaggggaaatggcagatgcttataaaaccatcagatcgtgtgagactcactctttatcaccgggaacagcatggaagtaactttccccatggattcacttacttttcaccgggtccctcccacaacacatgggtattacaagaactataattccaagatgagatttgggtggggacacagccaaaccatatcacctaccttagagattattatgagtaatttataagatgattcataaagagtatcacagtttctgggaaattatcaacagaaaatagatgagaattattctcataatgactaccaattcagtttccaaaaaaactttgttgctgtatgttttacacatgtaaaacttacctatctcaaatgattccatgattttaataacaacattgagtgagtgcaacaatcatcacaatttattcagttttaacatttttatctgaaagtttttactcactt

SEQ ID NO: 9119 - DNA, 562 bp, Homo sapiens
tttttaaggataaatcacatggatctgcctcttctccataccaagtcatacccagagggcttcctgcgtccagcactaacctcgcacctctccggacacacgaatgggtggtggatggtggagcgcagagctgatgctgcttctcacctgctactcccctgacctgccactccctggtggtctccatccttgagagagtgtcagccttgagggaagcacatggatgtcaggttgttctaaggcaagttactggtggagctccctgagcctgcctgtgccctctgggactgtcgctggactccaatggccagtcctcggagcacattgtccagtgattgcacctgagtgtgccttgggcaggtgtgtctggtcttcaggactcctttgtcgctagagtctgacgctggggccctctttttgtttgtttcgaggcaggtacaggtgacacattcttggatctggtcatctctaggacaaccagcctcagaggagagacattgtctcagcgctctccagctctgagaatgcctgcagatgccttcttctctgataactccatgtc

SEQ ID NO: 9120 - DNA, 458 bp, Homo sapiens
cacagcctcgtttcctctagatcagagagatggcttctggattcatctttccctgcaatccagcttctcctcctggggccctcataatggagactgggatcatcatccaggcttttgcactgggttaggaatttgggagtcatcctggatccatctgcccctgtcaacctttctctgtcaacagatatttactgggcatctccaacagccaggccctgttcatggtgctgaagaacagcatgtataaaacaaccctgccctcacagggcgatcaccagtgacctgtggtgtggagtctccttttacctctgtctcctccttcccactgtcaccatccttggtcctcctctgtcacctggaatactccacttggtaaccagcatgatcttctaacgctagttttacccttgtcagcactttgccgaaaacctcaaataaagacttttttaaaaatgtgc

SEQ ID NO: 9121 - DNA, 470 bp, Homo sapiens
aggtgtctctaaattgattgctgcctctgatagactattctaagccacggccatctcgtggagaaattaaacattctgtgtgaaggacatgcatgtccttaacagaacagtgaagttgctgatgcatttttattctcagccaccctcacggcaccccagtacctaccccatgtcccagcctcatggggccttgctctcatctgcccattagctaatctgggctaagaagatgtactgcacaaaaagaaagaaggaattcaggcttttaaatgaaatgcccaatttgtaactgttggctaccaatgcaattagttagaaggtagttctcagacaggtgggacagttcttctcctaacaagcatgtgtcaaagcatgcttgtttcttctaacgttttgtttttctaaaaaagtgtgctttcttcttctaagaaaatctggcaaataaaatgttattctcctcatgttaactg

SEQ ID NO: 9122 - DNA, 445 bp, Homo sapiens
aaggtccatatgaggtgctccttgcccatttctgtgctgccaaactaaaaggttcactctggattcacacttcttatttaaaggaagttcctacccctgctggaattcagaaacaattagaggcctgaagctaaaatcgacctaggagtggagcagagaacagctaaaggtgaccacacacccaagacccctgggccaggcctggatatcattaagctcccggaaatacctgaaatacttggcttcttatctgttgctttctctatactcctagtttttgtctttcactcccttgcacaacagaattactttaaattctatcttgccctagtgctgtagccagtacctcgtgttatactggaataaatacatctaaaaaagtagagcccgagttggaaacattctcactacttagctaaataaagcattcaccatggaatattcg

SEQ ID NO: 9123 - DNA, 381 bp, Homo sapiens
gagcgccagctggacctgggcaccctcaacaaggtgttcgcgtcacagtggctgaacgccaggcaggtggtgtgcggcaccaagtgtaatacgctgtttgtggtggacgtgcagtcaggccacatcacgcgcatccccctcatgcgggacaaggaggccgggctggcccaggcccaacagggctgacggcatccatgccatcgagctgaatccctccaagacgcttctggccaccggcggcgaaaaccccaacagcctgggccatctaccagctgcccaccctggaccccctgttgcctggggcgaccgccatggccacaaggactggatcttcgcagtcgcctggctgagtgacaccgtagctgtgagcggctcccgcga

SEQ ID NO: 9124 - DNA, 735 bp, Homo sapiens
ctgtacatcaattagcaatttgtttgcatcaaagagattttaaagatggagaccatctctttactttaggcacagttgcacaggacccctaccttggctcgtaagcccagaaactcaatttcagtttacccagaagacatgtcctgataaaactaacaagacgcttaacctattaatgtataatggacatctgctggtccagataagtaagacacttagggaagcaaggttgtaggtcaaagatagtaagcatttaatttgaactgagagaatgagtttagttttttttatggggtggggcttgtgatcagattttttttattgtggtaaaatatacataacataaaatttatcattttaactatttttaagggtaaaattcattggcattcacagtgttgtgcaactatcaccactatttccagaacattttcatcaacccaaatagatattctgtaatcattaagcagtaattcccctttgtctcctcccacagcccctgaatctactttctgtttctataaatttgcctagtctagatacttcatataaatggaatcacgatgtttgtccttttggacttcagtattcttaaaggatatttctgcttttctactctacagattgtctgtttaaataatggttttcaaatatcttttgatggtatgttttatctattaaaaaatttaagtgatatatatatttgtaacatacatgtactctgtactaatatat

SEQ ID NO: 9125 - DNA, 481 bp, Homo sapiens
tttctcttatttggatatctgcaatggtcactggaatgctgatttatattggctagacttattactcccccacttttataaactctactatgaagctcacatatccaactgcctgcatggatctcatgagacaatctggcaattttaactgcacagtttctttaataaagatgactgaatctgtataaaaattttgcttaggccggacttggtggctcatgcctgtaatctcagcactttgggagactgaggtgggaggactgcttgagcccaggagtttgagaccagcctgagcaacacaagatcgagtctctacaaaaattatctgggtgtggtggcacatgcctgtagtcccagccattcgggaggctaaggagggaggactgcttgagcccaggagttccaggttatagcatgccatgattgcaccactgaattccagcctgaatgacagagtaagaccctgtctctaagaggcaaa

SEQ ID NO: 9126 - DNA, 1645 bp, Homo sapiens
acatggtctctgtgtgttctaatccctgttcattctcatttactgtctaaagttgaggagatgggatgtcccagatgatagggctcctgggatttcagacccaagaccagcaggactccagtcacctctaccccagctctccaggacacagcgctcccaactctgagtgacgtcccacctctggtccttgcagcacaaccaacgtgggaatcacaccctccagacctcccacagctccaccccagactgggcgccggccctgcctccatttcagctgtgacaacctcagagccgtgttggcccaagcatgacaaggacgtatgaaaacttccagtacttggagaataaggtgaaagtccaggggtttaaaaatgggccacttcctctccagtccctcctgcagcgtctccgctctgggccctgccatctcctgctgtccctgggcctcggcctgctgctgctggtcatcatctgtgtggttggattccaaaattccaaatttcagagggacctggtgaccctgagaacagattttagcaacttcacctcaaacactgtggcggagatccaggcactgacttcccagggcagcagcttggaagaaacgatagcatctctgaaagctgaggtggagggtttcaagcaggaacggcaggcagttcattctgaaatgctcctgcgagtccagcagctggtgcaagacctgaagaaactgacctgccaggtggctactctcaacaacaatggtgaggaagcctccactgaagggacctgctgccccgtcaactgggtggagcaccaagacagctgctactggttctctcactctgggatgtcctgggccgaggctgagaagtactgccagctgaagaacgcccacctggtggtcatcaactccagggaggagcagaattttgtccagaaatatctaggctccgcatacacctggatgggcctcagtgaccctgaaggagcctggaagtgggtggatggaacagactatgcgaccggcttccagaactggaagccaggccagccagacgactggcaggggcacgggctgggtggaggcgaggactgtgctcacttccatccagacggcaggtggaatgacgacgtctgccagaggccctaccactgggtctgcgaggctggcctgggtcagaccagccaggagagtcactgagctgcctttggtgggaccacccggccacagaaatggcggtgggaggaggactcttctcacgacctcctcgcaagaccgctctgggagagaaataagcactgggagattggaagcactgctaacattttgaatttttttctctttaattttaaaaagatggtatagtgttcttaagcttttattttttttccaacttttgaaagtcaacttcatgaaggtataatttttacataataaaaatgcactcatttaaagagtagagatgactttgacaaatatgcatgcctaggtgactaccactccgatcgcaatagataacattgccatcgcccccaccagtcccctcatgcctctgggcagtccaaccacttccctgtttccaggccagtgatctacttctttttcactatttattggccttgcctcttctagagcttctagaacttcatataagtgaaa

SEQ ID NO: 9127 - DNA, 1039 bp, Homo sapiens
tccagcgaaaaagtatccacagagagaaaatatcgaggcaaataccgaagcacgaaaacatctccaaactcctcagttgatttaacgaagagctaaagttgagaatcactagtttaaggagttggctgggatgggaagaagtcaccactgcccttctgtcaccgcagaattttgtccagaaatatctaggctccgcatacacctggatgggcctcagtgaccctgaaggagcctggaagtgggtggatggaacagactatgcgaccggcttccagtgagtgcaccctggctttctgtgccaatgtcctccgtcagcgtttcccccagggatctgactggcagcctctcctcccctgaactgaattctactccatctacccttcctagcttgctgttgtcttttcctctcaggaactggaagccaggccagccagacgactggcaggggcacgggctgggtggaggcgaggactgtgctcacttccatccagacggcaggtggaatgacgacgtctgccagaggccctaccactgggtctgcgaggctggcctgggtcagaccagccaggagagtcactgagctgcctttggtgggaccacccggccacagaaatggcggtgggaggaggactcttctcacgacctcctcgcaagaccgctctgggagagaaataagcactgggagattggaagcactgctaacattttgaatttttttctctttaattttaaaaagatggtatagtgttcttaagcttttattttttttccaacttttgaaagtcaacttcatgaaggtataatttttacataataaaaatgcactcatttaaagagtagagatgactttgacaaatatgcatgcctaggtgactaccactccgatcgcaatagataacattgccatcgcccccaccagtcccctcatgcctctgggcagtccaaccacttccctgtttccaggccagtgatctacttctttttcactatttattggccttgcctcttctagagcttctagaacttcatataagtgaaa

SEQ ID NO: 9128 - DNA, 737 bp, Homo sapiens
acatggtctctgtgtgttctaatccctgttcattctcatttactgtctaaagttgaggagatgggatgtcccagatgatagggctcctgggatttcagacccaagaccagcaggactccagtcacctctaccccagctctccaggacacagcgctcccaactctgagtgacgtcccacctctggtccttgcagcacaaccaacgtgggaatcacaccctccagacctcccacagctccaccccagactgggcgccggccctgcctccatttcagctgtgacaacctcagagccgtgttggcccaagcatgacaaggacgtatgaaaacttccagtacttggagaataaggtgaaagtccaggggtttaaaaatgggccacttcctctccagtccctcctgcagcgtctccgctctgggccctgccatctcctgctgtccctgggcctcggcctgctgctgctggtcatcatctgtgtggttggattccaaaattccaaatttcagagggacctggtgaccctgagaacagattttagcaacttcacctcaaacactgtggcggagatccaggcactgacttcccagggcagcagcttggaagaaacgatagcatctctgaaagctgaggtggagggtttcaagcaggaacggcaggcaggggtatctgagctccaggaacacactacgcagaaggcacacctaggccactgtccccactgccatctgtgtgtgtccc

SEQ ID NO: 9129 - DNA, 391 bp, Homo sapiens
agacagggtctggctctgttgcccaggctagagtacagtggggtgattatggctcactgcagcctccgcctcctgggcataaacgattctcccacctcagcctcccgagtagctggaactacaggcacacaacaccacacccagttaatttttgtattttttgtagagacggggttttgccatgttgcccaggctggtcttgaactcctggcctcaagtgatctgcccactctgcctcctaaaatgctgggattacggagtgagccaccacacccggctagcgtgtttcttaagttggcaattttgaagatagaagccatttctttgcccctttgtttctacagttctaatatgtgactgaattggcaaatcaagaaaaggggaagtcagt

SEQ ID NO: 9130 - DNA, 385 bp, Homo sapiens
gttgacctggggggatttccctaaggagcaacgctagctaagatttaattagtgcttactatgtgctaggcacagtttcaaagactttttttgtgttaactcatttaatcctcacaaccactctatgagtgaagtagcattattgccgtcttaccaatgaggaaactgaggcatgaagaagttaggcaagtcatccaagcataagcagttagtatgtggcaggtctgggatatgaacccatgcaatctggattgacatagatattttaaaataacttttttttttttttgagatggagtctcactctgtcacccaggctggagtgcagtgagctgtggctgcatcactgcattccagcctgggtgacagggtgagaccctgactc

SEQ ID NO: 9131 - DNA, 302 bp, Homo sapiens
gcttcttatgtccttttattcttactgtttatcccatctgctttcctttaaatgggcacaatttagactttatatcctaagaattctctttgatgagaccatagccatttctatgcctaatttatgtagtggatacattataaatacaaaaatttaggccaggcgtggtggcacatgcctgtaattccagctcctcaggaggctaaggcataagaatcgcctgaaccttgaagcggaggttgcagtgagctgagatcgagccaccgcactccagcctgggtgactgactgagaccctgtctc

SEQ ID NO: 9132 - DNA, 351 bp, Homo sapiens
ccagtgacctgccacagcagcaaaagaacagactcctatagaatcatcacatacacccttaatcccactgaaattgcattagcatgccaccacatggccacagcgacccctgccccctttcccttgcagtgacaatttactggatcaggccttgcagtgaggggccagcttctgaacttgcagagccaggtacaaaatgaaaatgcaggccagttgttcaaaaggcaggaaaaaagggccattcacgatactaaaataaaaacgtttccctttcttccagtttctctctcgatttgtcaagacatttttgtttgcaacttaatgtcattttaaattattagtgtgaatctt

SEQ ID NO: 9133 - DNA, 555 bp, Homo sapiens
tgaaaagctatggagaactatgataggaggagtgtgagctaaacgcaatgaactgggggaaacttagcaaggtctgttcagatttctctctgtatccttctttggaggtcagcatgtttcctccccccgtagatacggagggcacttctcacatgagggtcttaccacctgctttgggtgagggtcagaaagtccttcctaggtttcgtgacctgcctcaggagagaagggttggggaaggtcagagagatgttcctgcacaagctgcttctcaaattctttcagcttcaaatattcagtgtgcccaggtgccacattttggggtagcatgtcctgaaccttgtcaaaactatatggatgttttaatatagttttaaaataaaatgaagtcaaaagttggggggaagtagtctctaaaaattgaaagcagccgagcactgtgactcacagctgtaaccccagcatttcgtgaggccaaggtgggaggatcgcttgaagccaagagttcgataccagccttggaaacagccagaccccatctctacaaaaaaagaa

SEQ ID NO: 9134 - DNA, 391 bp, Homo sapiens
acaatcttaccgactgggggaaaaatgcttagttacaatttttaggggggaattactgtcatgctgctgagaaatggatcctgtcttttttgaccttccttccttcctgaacgtcctctgctaatgttatttctgtgattcaaatactgccaagcacagcacaagtttttgctggaattgactttagaatggacatgtgagtgtttataataaggaaacagattctttttttcataggctctgtacttaaaatatttattatcctgaataaccatatacccccaaaaaagtacagtttggctactgtattaaaatttgaaaatatcctgcattacatgtttagtagctcagaggccacttttattaaatgtaaagaccaaaacttctgtga

SEQ ID NO: 9135 - DNA, 701 bp, Homo sapiens
tttaaaggtagcaaatctttgttgagtaacagagtccagctaaaagatttaaactgtgcagggcatttgttgtttcctgaacagaaaggccaagatatggtggtttcaggatgcgttggagctgatggttttgtcatggacccaggctcttttcattgcccctctgccagccccactacatggcctacccccttgatttggtcaacaagtgcacaggaagattgctgttccatcacaggtgttaaaagctttagacaaattaaatttaacgcagtttagttgagcaaagaatgattctagaatcaggcagtccctagaaccagaataggttctgagtgacttggggctgccacgtggtcagataacatttatggacagcaaaaagaaagtgttgcacagaaaatgaaagtgaggtgcagaaacagctggattggttacagctgggccgtggccttttttgagtctgctctaaacaactggccacatttggttggctaaagctcagctacgagagtagtttacacatcaaaaagtctgtttacgcatcagagtaggttaccattcactatgtatggagatgagacacctttaggccaaacttaaaatatgtacgaaggcagttttaggccaagcttaacttaacagaggcatcacgtgacaatgtcctaagcagagggtaagaaagatgatagcaaaaaaaa

SEQ ID NO: 9136 - DNA, 396 bp, Homo sapiens
aattgcagtaatttgagaccaatttttccccattacccttttgagataaccctctgattaaattagctattattaaaataaagtggcttcctcttcatgttattagtagggtaccagttttttggtttttttttttcatacatggctaatttcacatttataaatggtgaagtgtgtattgttgaccttttgaagcaagcaactttctgacttaagattacttggattatcattcctgcttgtttgccttctttaggttaatagtatttgttttactttgctttattttgtgcagtgtgattttttttatgaccttctattgagtgattgccaaatagaacagcgtatgatttatggatactaataactaaaatatatatgaattgcaggctgata

SEQ ID NO: 9137 - DNA, 416 bp, Homo sapiens
gcaacagagcaagaccctgtctcaaaaaaatatatatatttttttttaattagctggacatggtggtccatacctgtagtcctagctactcaggaggatgaagcaggaggatctcttgagcccaggaattcaagtctgcagtgagctatgatcttacacaaattttttttaaattaaaaaaaaaattttctgtaatctcagtatctctccaattctgtgtgttcatccattcatttctgtgtatacttagagagatgtgtggaatggtactccactaatattaacaccttttctttctgggtaatgggacattggttgatttattccttttactattttgtgcttttatgtatttcttacatttttcatggaagcatgctttattttataaaaattaaattatttgcttaaataag

SEQ ID NO: 9138 - DNA, 328 bp, Homo sapiens
agggcagcatctctagtgagggggccagggcttctatttccttcattaaaaaatgaaacagcagacctgattccatatttagagattacacttagttgccactgtgggtgtgcaggcaccaaccaaacccagttggcaccgttgtcttttctctgcaatgatgtattgaatttaataatggaggtatatgaaattcagagtgattggaactgaaggtttaggggctttgtgtaaaattgatatgtaagggatttggaagtaggtgagggattcttccccaatacttattcaattttggagtcaaataaccaagcatttacaaatagcc

SEQ ID NO: 9139 - DNA, 394 bp, Homo sapiens
tccctcccgcaaagtgacatgtaccaaatcttgcagccaacaagctatctttgttggacagaattatcctacaaggattagacagatcatagacaaggacagacagccccaggaagttgaggcatttaaggggaagatattgtatcaaaggcatccccaatccatgccccacagggatcctgtaccacatctaaaccccacttgtcagcgtcaagtcaccctggtgtgtccagctgtcccaattagtggcaaaagcactgtgttcagtgatgtgcctttactaactggacacaaaatgcattggaagtatttgcagggaggcaaatctccccccacaaaataattcactacttgttgagaatcttgattctccctaataaatgttctaataaga

SEQ ID NO: 9140 - DNA, 703 bp, Homo sapiens
ttagtttctgccctcaaggggaagggattaacctgggtgtgcacaccagggggtggggaaacttcccattctattaatgcgtttaggttatttagaccaatgtctcattaattttaaaaaaattaaaaataggccaggcgcaatggctcacgcctgtaatcccaactttaggaggtgaaaggatcacttgaggccaggagttaaagacgaacgtgggcaacacagtgagatcccatctctacaaaaagtaaaatacatttacaataaaaatctacaagttctgacccataggagagtggaaaactcaaaggctgcttttgtcctgaaagaatttgcctattctaataaaacagctgaggttgaaacggctcagcctctgaaaggggtctgacccttccttgagcccttgcctccagtgacaatctcccaagctaagggagaaaaggaaccaaaagtctgcactcctctctacctctagcagtgcagggagcgaaggaaagacaagggaagaaacccttcagattttcagatcaaattcacatcactggccatccaagaaatcttaagctctgcgtttatcgtcaaccatttctgcatgagggaagcaaacagtccttgctgaaggaaggtgcctgcatcctgggcctcggaacccactgaaataatttagcgaagtgcataataaaaataatatttgccctta

SEQ ID NO: 9141 - DNA, 406 bp, Homo sapiens
aaccaaaagaatgttaactcataaattatcattttaggatataatttatttaaagtagtctaagttattttcatttatcagagcagttttactttgagttatgaggattcgagattgagtaaatcactattcttgtgataggttccttcccttggatatttgaatgcttcccacataataaagcacatggaaaggtttatatctacccttaagggaacctagggagaaagagatggatgtgtgagagatgtacataaataatagtgtatggtgaaggataccaggagtacaatgtagtctcatgagatataacttctaaataagggtataggagaccaagcatggtagctcatgcctgtaattccagtaccttgggaggccaaggcaggcggattgcttgagccta

SEQ ID NO: 9142 - DNA, 446 bp, Homo sapiens
gagcatcctgagcatcgatggtgagaagctacaggaggccgagcggctgttgacgcccaggaccgtgggcagcaccttgcagggggaaaccggcttcctccggtctcccagaagaagagttcaggccttctctcctctctccaggcctccagctcttccccatccccgctctcagcggaggactggcttctgttttcactgaagaaatcacagcctcctgagaggacttccccagacgcagccctcccctgtacccgctcctcctccacatccccaccttccatgcccagggcagcaaaccaccccccatctgcttggggatgtcaacaggctccctgtttcctgaatcttcagtttctccttcctgcttgattcccatccacaaacttaccattatgtttcttgtctttaaaagaaaaataaaatttttgctttttatccaaaaa

SEQ ID NO: 9143 - DNA, 2052 bp, Homo sapiens
catcgaaatacctgcagttcccaaatacatctggcctcacagggttgttggggcttaaatgtgcaaatacgagtaaagaggtgagagcggagcctgacagcgcacctgctgggcagggtctccaacactgcagcattttgggggaagctctcctactgggtggggtctttgtacagcagcagcatttcaaggtgggctgatccttctcatctggggaagccagggctgggcaggtgcctgagcctcatgagggtctcagtctagatgttgggccctattctccctgctgccttgggcttggagatgctcacaggtgagttctcatttgtgaagaggtctgtcttcctgaggaagcaggggaccctcacctgtgaaccaagtgtgccatgggagctgctccatgtccaggtccaggtctcctggtctgcagggaacggcacaagagggctggcctaggccaggaggatgtgatctgtcctagaagggggctgacctgcttgctgaccccgcttgctgctgcctggctgacctgactcagccacggctgttccgagggcccttctgagtacgaacttccagttggaggatctgggtgaagacccagctgcttgagatagcagcctctggctaggcccttggcgtggccaagccaatcaggcaggtttagagcctggtgcccctagacaggtcctgcaaccaagaacaggggtagccttcaaaggccagccctgccttccaaccaccgctccacagcgagggaaaccaaggctcttagggcaggaggcttgtccgagattagcacctgcgtgctccaggctctgagttctgtcccctcagctgtccggcccctgggtgctcactttaatctcaagtcattcatcttactattaaacgtgagcccagaaatattgttgtaatggagaacgatgcctgcgagtctccaaagccttccctcggaacggttccattaaatctctcctgctcagaaccacccaatccaattcatggagcgccacgtggtctacagcacagctggttagggccagcggaggtttatttatagctgggctcctggctgcctggtaaccggccattgccacctttaaagagtcttgggatattatctacctctattcagcttgaaatcgggcatgcagtgccttgggctggggctggcgataattaaatttctatcatgcacaattatggatgcaaagaatgaatgacatcccactggcatgtgaggattcgggcagcttctggactgaaatacagacttcataattgctccatccagattgggacaaagactgtggttgggagaacatgcctgaacaaagaaaaatgactctgcaggaccaaagttcttgacactaattgatctgccaaaaggggaagaatgagtccagctagaatccaggactaaccagcgggtgagcttcaaggaacaaagggcttccgctgggtcagcccacgagagggagctgcctgcaggtacctgggagggcacagccaccgtgtctgttccttgggagcagggctccttggaaggcagcgccagctccagaaaggccactgttccccctcccacccaccccaggtggcaactgcccctgcaggtcacggtcccagggcctcgctcggccggcctagagagagaaaagggaagatgcccaattagctggacgcccatggccccagggctgggggaccttgggttatcctgaaagaaggacaatgaccacctgcaaaggacgatttcaagtggagcctggaggaggcggcaaatagctcagtccgcactcaactcccttcccagccgtctggtggaaggtgaggagcaaaagctcatgctgctgaggcctggggccacccaggcaccggcctccccgtgctgagcagagacagcagccccctagctgcaggagtgtgccccgatgcgcacctgccgactttccttctgatgcagacatggtccccactggggcaaggctgcagttttcttttaaaaaacagatctttcaaaataaaaggggccttgaagaagaaaaa

SEQ ID NO: 9144 - DNA, 772 bp, Homo sapiens
gcgtgcctgtaatcccagctactcgagaggctgaggtgggagaatcgctggaacctgggaggcagaggttgcagtgagctgagattatgccactgggtaacagagggagactccgtctcaaaaaaaataaggtttgaaaatcactagtttaggctaagtgcagcttatgtttaggtgttaaccaggaagaagtaaggatccttgtgtagctctcagtgcaatattagatatgcttttcttagtggaaatgaaagttttgcattcactagtgtaactgatacattagtcatcactttgggttatgttcaggttttggttcccgaacattataaagtagcaaagtttacacctgcagttgaaggaaagtaggacacactatgacacactagatcctcacttggagtagtttaaaatgtaatctggacaagttggacttagaggctagctttttcttctggcttatctgtgcctgttcagaggtagctgggttgtcttttgcttatctaaaacaggcttatctttttgtttgttttgtctttctttcagatgatactagtaaatgcttttctgctttttttctgcccgtaaaaatacagactatatggtgccatccttgatgtggtagctctgcagaactaccatagacaagctccactaattcttggtgtgccagatcctgcagactttaccttgagcctgctaaactgggactgtcatctgttgggtgatgccattgcactccagcctgggcaacaagagtgaaactgtctca

SEQ ID NO: 9145 - DNA, 638 bp, Homo sapiens
aaacctacatcctgtttaggtggaaagtatctgagacttgagcacagccatagtctcatccaggtatgacatgtgccactgtgtctgaaattcctgagcaccgagggccgcttcaggcaccaggcactttgccaacctgagagctgtatggggctggactgtctagtctaactaggcagtgaaccctgtcctgaacagagcttgtttgttcataaagcactctaaagcagtgacttttaaatcttgatctgtgcataatctcactcctcccaaagagtcatcaagggagagcaaacacccaagggtaacgttggctcacgttcattttgttgttgttgttgaatttttgcttcctcctatgactaagcagaaagagagaaaagcagtgtttgggggcctcttctcaggctgtgtttaaacccaggtcacttccctcaacaggaaaatggattttgacaggccatcttgcttagagatttccctaatcacaccataattaatgccaaatggtttctttgctaaccttagtagcacttgaataattaacttttactcttttctttttttaaaagatacctgcgaatccactgaaaagtacattaaacaaaacagtatagttttggttccccaaatgtgga

SEQ ID NO: 9146 - DNA, 384 bp, Homo sapiens
tttttttagttgatattttattttattgacttctctcaaacagattctattcactcttctatgcacaatttcagcctgcttggttctttaaatcaattgctaaattagaaagaaggcactgctacaagataactagaagtgttagcttgatcacaaaggtcgcgaaacgaaagctgtaaaatataaagccagcctgagcaacatagacagacctcatatctaggaaaaaaaaaaaaattagctgggagtggtggtgcatgcctgtggcccagctacttgggaggcagaggtgggaggattacttgggcctgggaggtggaggcagcagtgagccatgtttgtgccactgtattccagcccagacgacagagtgagaccctgtct

SEQ ID NO: 9147 - DNA, 899 bp, Homo sapiens
actgtaaagtgcaatgtgaaatcaaagattatagtcattgtataatttggcttggaggctatgaaatgtctttttttctttttggtattttacattattcacattttagaataacaagaacacccaagaattacccctaaaacagagaccctgtatttaatcctactttgatcagagaagtagaatttataacaggttagctaaaattgggagcatgccttaaaacttaaagattgtatgcatatatgtgtatatgttataaacgtgaaatatatttgacacacacattcacatataaattgttaaaaactgaaggcagaatggaactaatatatgtaacagagaaaaacaataaattttatgaacttgttttatatttgcatatcaagagtcaagtatgatgtttctttaagttgactttttttacttcattatttttaggaataaatgtaagattttacaaatcttttatttccccacaagatctgaagtttggtatttttgcattatgacagttgttgagactaggattttaagctaggatatgattatatttcctatataactaaaaattttgtttcataaattttaaaataattatttttgactatgaacattagtccaaatttaatatttgacacagttcataccagcttgctacaataatgataatttattagtctttctgttatttaaagaataaaaacatgcttataaaagacttttaatgaaatgttgcctttttaaaataattatacttgcacatgaaaataaaatataaagtcaataatagtccttgtagcccaatgggaattgattctgtttattgtctgtaccattttgctaccagttacattgaactgctttaaaataaataataaaattatttctaatgatga

SEQ ID NO: 9148 - DNA, 435 bp, Homo sapiens
gaaaatacttctgataattggcacctaccttgcaaaattaacaacttccttatcccttttgtgaatttcatatttgtttcagaaaatccaagtgtttcaaatattcataaattccagggtttaatgtcgttttagtaattagaagttcataatggagagagaaaacagcagatttcttatactgtttccagtatgtgattcatacatgacaggtcacctgttaaaagctaagtgaaattgccattatactcaagtggcaggatatattcctgactgacgcagaatgaaagggtgtgatttaaagggccagatagaaactgtgtttctagtagttacttgaagagacagcatattttcactttagtctaaaatattgtgatagaaaagagaaataaatgtacatggaaataaaacttgtaaaaatactgagcaaaa

SEQ ID NO: 9149 - DNA, 582 bp, Homo sapiens
gggatattaacatatcatttacaggcatagttaataatcatgggcaggcatggtggctcacacctgtaatcccatcactttagaaggccaaggagggcagattgcttgagctcaggagtttgaggctagcctgggcaacatggcaaaaccctgtctctacaaaaaatacaaaagtaaaccgggtgtggtggtgcatgcctgtggttccagctactccggggctgaggtgggagggttgcttgagtgagggaggtcgaggctgcagtgagccagatggtgccattgcactccagcctgggcaacagagccagaccctgtctcaaaaaaaaaaaaataataataataagcggacacagtgtgcctgtaatcccagctactcgggtggctgaggcaggagaattgcttgaaatcaggtggtggttgcagtgagccgagatcacaccactgcactccagcccgggtgacagagcaagactccgtcataaatgaataaataaataaataaataataagtaacgatccactgtggcttcctggaaacatccatgttcacagctggggtctggtcagtctgcatagtgg

SEQ ID NO: 9150 - DNA, 462 bp, Homo sapiens
tcagcaccttcattcagatctcaggtacagtagaactggctgtgaaatgtgggtgaagcacacctacagtgaaatctctacagtattctctcctttggggttgaacagcagcagtctcagtcttttctgaatgataaacctaatgaaaaggcaggtggcaacactgaagcttggggaaggagtgctcagaggagaaggatgtcctgggaagtgtgctgcactgggtgtcatgccaggcgagcctcaggcccacccctgcggccttagcaactttggggacaagtcaggtaccctccttgtgcctttaattccttctagtgctgttgggaacaagattggctgttggagccaatcttggagggccttttcagtgtagatattgtatgattattcaagtaaattagagagaaacttagacattttaatttttctgcttaccttttactttattaaactgaattt

SEQ ID NO: 9151 - DNA, 811 bp, Homo sapiens
tgatgaggaatctgccagtagtcttatggagctcctttgcctgtaatgagtcacttttctcttgctggtttgaaaattctgtagttgtctttgatttttgacattttgactataatgtcttgttctagacctttttggatttattctgtttgggcttcatgaatctggatgttcatttccatgcccagatttgggaattattgagtcatttttttaattagggtttttaccgctttctctttctcttctcctctgggccttccataatgtatatattggtttgatggagtaccatgatttccttaagatttcttcacttcttttcattattttttcattttgctgttctggctgtaatttcaaattgcccatcctcgagttttcaaattctgtcttctgcttgataaaagtttgctgttgaacctctcttgcgattttttaaatccagttattctttaataaaatccaattttctagtattttaaaaatttaattatatttattttattttatgttatttttaagatgaggtcttgctgtgtttgttgcccagagctggagtgcagtggtgtgagcatagctcactgcagattcaaactccggggctcaagcaatcctcctgcctcagtcttctgagtagctgggactacaggcatacactaccatgcctgtctatcaaaaaaaaatttttttatacaaggggtcttgctgtgtcacccaggctggtcttaaaatcctggcttcaagcagtcttcccacttcagcctcttgagtagctgggattacaggtgtgagccactgtgcctggcta

SEQ ID NO: 9152 - DNA, 1041 bp, Homo sapiens
gaactcctggcctcaactgattcacccacctaggcctcccaaagtgctgggataacaggcataaaccactgtgcctggccagttaactgtctaaaatggatttgtctacctttctattgtaagtacagccttacaaatattattgaatccttgataatgtatactcaaacagtacctcaaagttaacattctaaacatttgtagaattctgtcaatggagaaagaacagaccaattgagtaggatgtctctgtagaccctcagaaaaattcctggaagttttaacaaaagatgcttatttatgattactttttctctccaaaagtttgttttccctcctaaatttcagatgaggattctcagcttttgggctgatttttggactcttcatgtcaacaacctttcctttccctcttgatcattggtcatctcttattagtgctagtagccagcatgaaccccaaagacagaagtggaggcagtggttagcagggcagcacttggttggtctggcctcctgagcttagcacccatggacaaagctttacctgctggaggtcagatgactatggaatgtctttgaaggttctgctctgagatcacagcctttaagaattatccttactgggtataaagtttatttcattgtatctctaggagctggaccaccaggaggcagtcattctgtggggtctcaggcaatgtcttgtctacaacactgtctgtctagcttggcaggaactagttgtctcattctttgctattattttcctagtgagacagtactttgaagagggcagagagaaatccccaaagaggcagcgtccctcattggtggggccatgtggtccctctctttgggaagagaggtagagtctttcacagcatcagttgtcttaagaatgcatttgtggccaggtgtggtggctcatgcctgtaatcctggcactttgggaggccagggcaggaggattgcttgagcccgggagttaagagactggcctgggcaatatggtgagaccttgtctctacaaaaaaaaaa

SEQ ID NO: 9153 - DNA, 393 bp, Homo sapiens
  misc_feature (317)..(317): n is a, c, g, or t
  misc_feature (357)..(357): n is a, c, g, or t
  misc_feature (371)..(371): n is a, c, g, or t
atgcattaagtgatgacagaatggagaattaagattccatttttgttttttaaaattaaaaaaaattatatatggagacaagggtctagaaggatatattccatttaaatcgttaatagtagcaactgatgtcttctccggagagttggatgaatgaataattaatgttatctttagaaagtgggatggttaagccaccacacccggccagggtaaagttttttcttaaggagtattttgaggctaggtgtggtggctcacacctgtaaatcccagtactttggggaggccaagccaaggaggagaggatccacttngagcccaggagttccaaggacccagcctggggaccaaccntagggggagacctncgtctcttaacaattaaatttt

SEQ ID NO: 9154 - DNA, 933 bp, Homo sapiens
cttttgtcttccaggtggaaccagtccaacttacgtgtgcttaatgtattaggcagagaaagaaagagagagagcgggagcgagagagcacaagtggtcctttcggcagtcaaaactttggctttaaaactctcattcacgtttcccaacagcagtatatttttgccttctcattcaaagagttttggctaaaccttaattgtgttctgtctttcagtgattcacataccctccttctttaggttgatgtagtcatagtcttcactactattcagtacgttagttttatcaatattgcaatagtgttcagatcttttacacatgttagatgtgtggtgttttggggaaatgtgagctacaaagcatctttggggttgttttgaggaactacccatcatttatagccttactctaattacaaaatgcagttcaggttctagattgccaccattctagagtgtggcacacaccattctagggcgtgattcatttggatgttggaaactcaatgtctgttgtttgtatagtgttgatgtgtaaaatgctttaaaaatatgttctgttagttagaaatcttacaatgttgttcatactattaatcaacatttttggttattcagtaaaactttactatcctcaggccctccgtgttcttatttaaagccgctgtattatggcctgcttttctatgctacagattttcagaactactcaattctggtctatatatgtggtagtgcaatcagggaggtatttttgggggtatatggggtacacatctctttaaattcaggtagctatttacagtgaaaagccagttgtggcagttgtgctcagagtaggtgttgattttttattactgtatacatggataattctggatccagtatgtgatgtgttgcagaaaaataaataaaatgtgttcatcatctt

SEQ ID NO: 9155 - DNA, 516 bp, Homo sapiens
gcagctcccctgtccccggacaaatacttctcttccccatcctcccaatttaggtaaatcatcatttttatcaggttaatatacagtatttatattatttatagctgagtcacatagtaaactgcagttacttttatttcccaggattaataattagtattttgtttgcatagtgttccatgtacctattatttccaccccagactccttatcagaactatggatctcctctgggctggttcagacacacgtcaggtcacttacttgtttcattttcccttggagccttctctcctagagccctctatcatctggctcctcccaggacggagtgcactctaggcctgctgcccaactctcatcctggaatttgcatttaccatcagcctggaattcccttcacctttctctttcatagtagatcctctgttttttaaattccatgtcttcttcctttcttgccttggtggagtacattcataacagtttcttgagaaagggagcatgagcagtaaa

SEQ ID NO: 9156 - DNA, 489 bp, Homo sapiens
taaaagaatgatgaaaattgaccctctccagacaaacctatagagacttccactacctgctagaagatgcctaagcttctccatctggtgagatgctgtgatctgctcacccctcattcagtcaggaaaaggacaccttgcaaatccctgacttgttttgctggctgtgggcacacctagacaccagcaaggaagagaatagaaggcaaattctccccaaaccggctactgctttgaacacccttaactatcctagacccttctggtctcaatctttgaaactttataagttcttccagctatgccaggtttcttgaacttctgctaatagccttgtctaatagtctcgactggctgacattaaattcaagtataaatcttggaattcaaactcaagaatcacttgaacccaggagacagaggttgcagtgagccgagatcgtgccattgcactccagtctgggcaacaagagcaaaactccgtctcaa

SEQ ID NO: 9157 - DNA, 760 bp, Homo sapiens
ctctatatgtctcctgttgcaggttgttggatctttccagatcaccacaccacatcacccagccactctgcccaatgggagggcagacagtgttccagtgtaggaggaaggggtgtaaggtgcgggcagtttgtgaggagggcaccaacgagagctactgtgagaaagtctgcatggtcaaaaagtggattaccaagaacaaagcatcataatgttgtccagtggaccccagggtcatctggatgaaatgaatacttttagggcaaaatggctgatactgcttccttgataaccacatatagaaaactgacaactgtttagaacaaagccaaagatgaaaccaaatataaaaccactgatgaaaactaagtgaaaaatataagcaaaatagaagaaaaataaggtcgttatttcaagaaaacgaaagacagtcaatgctgttctttgtattcacatacaatttggttcacaccaaaatgtgagttgttctctatgagatgttattaaatgttcctaagaagactcgctttagaaaaaaacagtattcctaaggcatgtccaatctgtctcttttcttaattgctatagttctactttattattataatgtattcagcattaaaattcattatttcccaataagcttgactttatcttataatgaatacaactgtcttcttggtgatttttataggagatattatggaaatattttattaacagaagtaaataaagtgtcatatcatttggcttttcagcc

SEQ ID NO: 9158 - DNA, 363 bp, Homo sapiens
ctgtaatcccaacagtttgggaggccaaggcaggaggaacacttgagattaggagttcgagactagcctgagaaacataacaagactgtctctctacaaaacataaaaaaaattagctgagcatggtgacatgcgcctgtagtcctagctacttggaaggctgaggcaggaggactgcttgagcctaggaagtcgagatggcagtgagcggtgattgcaccactgcactccagcctgggttgcagagtgacaccctgcctcaaaaatgaataagaattaaagagatgaggccggatgcctcggtatttttggcgctgcgatcgcgacactgcactccagcttggggtgacaagactgtgtcaa

SEQ ID NO: 9159 - DNA, 1258 bp, Homo sapiens
gaagactcatgtacatatttagcaaattttggtttcttacatgtgcctgtcatgactgtaattcattatgactgctccaggaagggctaatggggccaatatattattgcctgtcatgtggcacatccatgttaaggggctgaggcgtccctggcacggaatgcagagccctgagctagggcatcagcagaagctgagatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtgaaagacttaaaaaaaagaatcacattgttcagaggtgctcaatggaaagaaaaggaaatgaacaagtttgttaaaagataaaaaataaaaaaaattccataccttgataatccttgaaatatcttttgcagaaatacaaatcaactgaaagacatgaaggtagattaggtcctacaggccagtgtgggacagggttgtgtaggtgtgcatttcaaacacatttattattcagaagtggtgcagataacgcttagattacaccgaagaatttagggagggtgggggatgaaggtctgttagtaaccagaaacacattagttgggcatcagtaaggggcaacataaaggaatggttcccctcaaaaacgaacaaaccaaattttatac

SEQ ID NO: 9160 - DNA, 960 bp, Homo sapiens
tctaaggccaaccggcgtatgaaggagaaacacctatgtctgggggcaggaatctgaggccaatttgtgctgacttctcaaagctggagcaaacggaaaatctcttatttgtttgtgacgggccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttcatcctgcatttacagaaaaagaaatgaaaacagagagcttaaataatttgccacagtaatgtcgaaactaggcctttgaaccaaggcagtctagggtaaaatatagtttcaaagtatgaataagaattggtatttgtgttatctttgagtaagaaactgtccgatatgaatcacaacgtgggtgaatgtagtattttcctgaagtgtgaaagacttaaaaaaaagaatcacattgttcagaggtgctcaatggaaagaaaaggaaatgaacaagtttgttaaaagataaaaaataaaaaaaattccataccttgataatccttgaaatatcttttgcagaaatacaaatcaactgaaagacatgaaggtagattaggtcctacaggccagtgtgggacagggttgtgtaggtgtgcatttcaaacacatttattattcagaagtggtgcagataacgcttagattacaccgaagaatttagggagggtgggggatgaaggtctgttagtaaccagaaacacattagttgggcatcagtaaggggcaacataaaggaatggttcccctcaaaaacgaacaaaccaaattttatac

SEQ ID NO: 9161 - DNA, 416 bp, Homo sapiens
gtaagtcctctaaatataaactttcagagttaacaacactttctaaggctgaagataaaaattctagaagtttctctttgttctgccaaattcaacaatggataattactcaaagctaacagacacttttgaagaagtcttaaaatacaactattctatacaatatactgccagcaagaaaattatcagcctgtaaagaggttcaggataaccaagtaaaggagactatacagtaagtgtttttccattccaaaaggatgttagaatgagacatctccatcctagaaaaccctatggaacggaaacctcattttcttactaatctcctgctgctttgaaattggaagcaatttccttttaaaataatattagtttgctgacatctttctattccattttcatactgatttcaattt

SEQ ID NO: 9162 - DNA, 423 bp, Homo sapiens
ttctttaagatccgaacacaagcagaatctttgatgtcccccatttcaatctaaaacccaaatatttgtaagtacgcagaacaaacctactcactcagagattctaaataaaaattcaggtgtctgtttgagactggaaatgagaatttaaaggcttctcactggttctaacgcacctactcagtcttatgttacaggtcctagacccaacccatggatcgcctggcaggactctggaaggagccataggttaggcaaatttccatgaagcaaaagtaaagcaagctgtgttctggcatctcagaaggtgtgaatccttgatccttctctaagggaaatacgaatgtagcctcataaaaatctagaaattcatgtttgaaatgagaactacaaaaactgaagaaacagaaaggcaaaaaaaaa

SEQ ID NO: 9163 - DNA, 684 bp, Homo sapiens
actaacacattgatcattcttgaatcaccttcacaattttaggtgcaactgtgggccatttatactgtttacatttaatatttctagtagacttacatttttatttaaaaggccatatgtttaaaaataaagctttgtatattactgtaatttggaactagcgtcatttattatgcatagaagataattgaaaaaatatacaataaacaaggcaaaatagattcaagtttagctagataaccatgaccttccaaagactctgagcctgaggtctgttctctgtttaaaatggcatttagcaaataatatagacatatgaaagaccacaattaagtctttcttcttaaggtaataagcaattactgaaagggatttggaaaggaaataagcttctccttatttaattcaacattttaaaattcaataagccacatcagctatgccaaacaccatctttgtacaacctcaaaccatctaatataccaacctgaaccactgatacttccaccataggaagagggacatttgttcttgcagaagttcttctgttctcaatcccttagttgcaggtaaacacactgaacttggattgggtgatgctaatccctaagcagaaagtatgttggtactctgttttcccacactgtaattattaagttcttacctggtagctgcacagatgca

SEQ ID NO: 9164 - DNA, 291 bp, Homo sapiens
atgatattcacaaactgatgcttgtttatggggcacatttagttgtaacactaaagaggaaagaaagaaaacggtttccacaagttaggatagtggctacttctgggggagggaaggagatggaatagggggacacacaggggctgctgggagggggctgaatactattctagacctggtggtggttatatgggtgttcaatttataatgacaattgaatgacacatatatgttttctttactcctctgcatgtatgacgtagctcacaaataaaatagcaacaagaacta

SEQ ID NO: 9165 - DNA, 419 bp, Homo sapiens
taatttcccgtgcacgcttgtacaaggctgtatgtgcagcggtggttgttgcagcattgttttgatgacaaaagaatagaaacaacctaaactttaccagtaaggtaccggtttttaaaatatggaaaatacattggagtatacaattaaaaaataatgatttggccgggtttgatggctcacacctataatcccagcactttgggaggccgaggtgggcggatcacctgaggttgggagttcgagaccagcctgaccaacatgaagaaaccccgtctctactaaaaatacaaaattagccggatgtggtggtgcgtgcctgtaatcccagctacttgggaggctgaggcaggagaatcgcttgaatccaggaggcagaggttgcagtgagccgagatcgtgccattgcactccagcct

SEQ ID NO: 9166 - DNA, 378 bp, Homo sapiens
acttataagctcaaaagtctaccagaagggaagaaaattggagaagtggacaggcagttatatgaaacggacaagagacaaatggcaaaaagcaatcaaggaagaagacagccggtcacttctatgtggaggcttctacctctgcagccatgggttcaagccccgcctgagggaaagtgggcactctgcattcactgagtcgctgcagtgttgctgggcagcaactcagtatactacgtatattaaaaaacaaaaccttacaaaagtttatgtacccattggtatcaattctacttctaggaatttatcctaagtaaacaaaagtcctaaagttttatatataagtatgttgattgcactattgcttacaatagatat

SEQ ID NO: 9167 - DNA, 556 bp, Homo sapiens
ttttgaaacagagtctcgctctgtcgcccaggctggagacaaggagactgcataaaattacttcaaaggctcttttcagctccaagagtttttattctaaataaaaacaaaacaaacaaaaaccactaataaataactaagaagtccctcttctatttttttaaatatccaaccaggcagtacaacttagtagctaaaagtacgggtttgatactactttctcttgagtaaatctggacaaattacttaactctacttgcctctgtttagaataagagtacctattttgtaagattactgtgaagattaaatgatacttcatttaatctttaacgatacttaacgatactttgttaagtatttaaaaccagtgtctgacacatgaatgtgtttaaaactagcagcttaacaaggaaagaaaaaggaaaggtggagatgggagaaaggcaaggaatgaaacctaaatgtgcggcttgttttcattatgtgtacccaagcctcaaccaaagcattgctggctgttgctggccagaggctgggttcccttggcaaccag

SEQ ID NO: 9168 - DNA, 825 bp, Homo sapiens
catggtggcatgtgcctgtagtcccagctactcggagaagggagaagctgagggggaggatcgcttgtgccagggaggttgaggctgcagtgagctgtaatccaacactgcactccagcctgtgtgacagagcaagaccctatctcaaaaaattatgattatatttctaccaatgagagcttttcaacaacgatgtcctaagaactgatgagctcccctattaatggaggtattcaaagagaacttgaaagatcatttgtcaggagaatgatagaaaacattcctgtaattggatggcaggctggagacaaggagactgcataaaattacttcaaaggctcttttcagctccaagagtttttattctaaataaaaacaaaacaaacaaaaaccactaataaataactaagaagtccctcttctatttttttaaatatccaaccaggcagtacaacttagtagctaaaagtacgggtttgatactactttctcttgagtaaatctggacaaattacttaactctacttgcctctgtttagaataagagtacctattttgtaagattactgtgaagattaaatgatacttcatttaatctttaacgatacttaacgatactttgttaagtatttaaaaccagtgtctgacacatgaatgtgtttaaaactagcagcttaacaaggaaagaaaaaggaaaggtggagatgggagaaaggcaaggaatgaaacctaaatgtgcggcttgttttcattatgtgtacccaagcctcaaccaaagcattgctggctgttgctggccagaggctgggttcccttggcaaccag

SEQ ID NO: 9169 - DNA, 494 bp, Homo sapiens
atattaatcaatcacagcacctctgagcccagagatgtcctcggaatctttcacacactgctcctgacagccaaacctacccgtcagtgggagctgaagtttgcaatttctgtactaacctgtatggcctttctaaaatggagacattaccaaggaatcaatctattaacagctgaaaacaaaccttgtgtgagctccagtcttatctgcctaggagggaagagcgtggtagattgcaggctgtgtgaagcacagcactcccatggcgacctcacggatcataactagagtctacactcagcacacaggcaacacagggccgttacccttgaaaagtgtaaaaatctagacgaagttaatgaggagactttttttttaagctgctatattttgtctaattcatatatgctacattttattctaaaaatagttattctactctttggcactaagtttggtgatggatataaaatagtgatcaataaacagttgtt

SEQ ID NO: 9170 - DNA, 675 bp, Homo sapiens
ctcactgaatctgccttagtgagaatgtcattaccttattgcttatattaatgcagatgtctttctctgccctccttgtttccagattgtaccatcataatcaacccttcatagggcttcctatcagagcagaggttctaatgactctctattccctgcaggatgaagtgcaaactctttagtatggcctgtgttttccatgactcgcccctgcctacatccatggcttcatctactacctttcccctcacaatggtctctccttagtagatagtgaaatattagtgtactattctttttacatgaaaatgacatagtgaaagagaaggactagtttagcctgtctttgcaggaaagattgaagaataaaataatgacatactttgaagttaacagacatggatttgaaccctagatttgccatgaaatgtctgaatgcctttggtcaatttacataatggcagaaagccttacaaattcctagtgaagattaaactcaataacgcgggcaaagtgcttaacaaaattgctggaacatagtacacctctacatgctcaataaatgggagttaattaccttttttacctccccttcccttcccaaatagtatgcattaccttttaaattttaaattgagaagtttacagttgaattaaaaaatgcaatgaatcaca

SEQ ID NO: 9171 - DNA, 371 bp, Homo sapiens
tcattctcctgcctcagcctcctgagtagctgggactacaggcgcccaccaccacacctggctagttttttctatttttggtagagatggggtttcaccgtgttagccagggtggtctcgatctcctgacctcatgatctgcccaccttggcctcccaaagtgctaggattacaggagtgagccaccgcgcccggcccagctaaactagaatttttaaaaagtcactgtatttcttgcaaggtaagggttaagtggcatgttttttgtttgtttgtttgtttttttgttgtttgtttgtttttttgagacggagtttcactcttgtcgcccaggctggagtgcaatggcatgatcttggctcactgcaacc

SEQ ID NO: 9172 - DNA, 344 bp, Homo sapiens
aaatgtctgcattaaaggaagcaactaggaaaatcaacgcccaggagagctggggctgttgaaaactgcaggaggtatttctgctgaaagtagggccgaccctattcagccagctcttgtcattccagttgaagagaggccatttgacattctagaggtggcagcatgcaaacatttaaaaccgttgagagaatacagcacaccagggagactattattatgactatcaggaggataataccaagagttgagagtaagtatgctccttatccagggtcaccataaaccaaacctcctaaactcaaatagattaaacaatgagctaaagagtctactcacttaac

SEQ ID NO: 9173 - DNA, 462 bp, Homo sapiens
gcaaaaataattcacttctaggatggtaactgcaaggaaatctgggaaatatagtttttaactttccaaatttatagtacaaggaggcaaacttgaaagaaattggaattgatctgagtaccaatctaccttacctacccaaaatttcacctccataaacatagtgcatctattttttcaaatcttttatgtattttagcagtgttttaaaaaccttctgaaggtcatgtgcattctttaatagatggattcccggatgttatagtttttattcttaatctctttcctattttagtcattgcaaatgtcttctcctggtgtgttaaatccatcatactcttgttaaatagaaacataaatttttgaccctgagttgatctagttgtcgatttacagaatatacaaaagacaaaattcagattataggaaatgagaggacaaataaactccaagggaacgaaa

SEQ ID NO: 9174 - DNA, 331 bp, Homo sapiens
ttatcacctcacctgtgagctgtgaccatgtatatgtcacaatttcacctgtgggcaggaaccagacatgagagtcctatcacctgggtgctggccaatagatgaaaaaagattcaaggaagacacatttgctttttattcactcatcacttcccatcactatgctgaccagagtcaatgtgagcagagttgagaatagcagttttctggcaggagagccacttctcagcgaaaaatgacacactcaaagtataaatctttcatggaaggctcacatattttcagcaaattaagcatatgcatgaataaaattcttgtggtgaaataaaga

SEQ ID NO: 9175 - DNA, 291 bp, Homo sapiens
acccctggctgagtattcaggtgatgtgactctcctgcctggttctgcccacagccaatagatgaaaaaagattcaaggaagacacatttgctttttattcactcatcacttcccatcactatgctgaccagagtcaatgtgagcagagttgagaatagcagttttctggcaggagagccacttctcagcgaaaaatgacacactcaaagtataaatctttcatggaaggctcacatattttcagcaaattaagcatatgcatgaataaaattcttgtggtgaaataaaga

SEQ ID NO: 9176 - DNA, 397 bp, Homo sapiens
tcagttctccaacttggctacacattgtgaccacccagagagatttagaaagtactaatgtctgggttccacccacagagatccttacttaactggtctggggtatggctcaggcaatagaattttggaaagctccccaagtgattctactatgcagccaaggtggagagtcactgtcctgaagtcatcagaggttgccacctactcctcccacaaaggtggctcctcttgtcaccttgcaccacttgcaagcaattagggatgtacatttacatgattttaaaagtcttatgatgtccgattaaaactaacaaaacttgaatttcttgtatcagttatcattcactcttctcaacaaccgtgtgaaagtaagtttattgttcccatatgacacacg

SEQ ID NO: 9177 - DNA, 619 bp, Homo sapiens
gtgtttcaatgcctctgggttggtttagatgtcggagtaatatgtgttccaatcactagacatatggaaacatggtgacaggtatctctctgtagtggggaatattttgggagctcacaaagcactctcccactagcaatggagagacttacactggtttgatgaggacaagactaaaaagcacctgtgtggagcagaagaaaaaattttttaaatacctaaacaattagctaaccagaccctaggaagaattgatgcctataatttctcagatagaaacccattactgctatgtggttaaagcaaaacgaaaatcccattactgctcattgggttaaagtagagaggagcttaagaaaacatacaactgtcaatcagaaaacctagaatgtgacattgtttttgccactgtttctctccccttggtttatcaacttctcttggccttcattttcttatccatgaaatcaaaggtcatgattatagtgtattatatacactaatacactaacataatatatactatatatagatactaaataatttctattattgtactcacttctaataatattacattataaatataaattatatgtgtatttaaaaactcatttag

SEQ ID NO: 9178 - DNA, 473 bp, Homo sapiens
atgagtctcctcttttctattttgattcccgtcagtcttttctccctttctgctagaacaatctttctgaaaggcaaatcctttcatgccgctcttctgtgtaaagccctgtcatgcttcccattgccagcagcaaacagtgaacctcctttggtgtgatttctgaggaggtcattcatgatctggcctctgccgctctccccagctctggttccctcctcttttcctgcacttgctctttcctgcacactccaagctgcatctctctctccactcttctggccaactcctactcagccttcaggtcaaatacctgacttgctctaggaaacctttcccaatcccataagactggatcaggtgttccttttctgtttttcctgggtttatcccaatcaaagcactttatccctgttttgtaattgcctgcttacttttttgtctcctccattaaactttgatatctttgaaga

SEQ ID NO: 9179 - DNA, 506 bp, Homo sapiens
cattgcatgctgcaaagaaatctttagtgaaggaaagactcaatcaatgagacaaacttcattgttgtcctcctttaagaaattgccacagccactccagccttcagcagtcaccacctggatcagtccacagccatcaacattgaggcaggacccgccaccagcaaaaagattacaactccctgaaagctcacatgatcattagcattttttagcaatgaaatattttaaagttaaggtatgtacactgttttttagaataatactgcatacttaatagactatagtataatataaacataacatttatatgtactgggaaaccagaaactttgtgtgactcactttattgtgatattagctttattgtggtggtctggaacagaacctacaatagctccaaggtatgcctgtaaattaaaatgataggatactgtttctcacattagagtaggaaaattgaaaaagcctgaccaatatggtgtaatcccatctctgctgggaaa

SEQ ID NO: 9180 - DNA, 409 bp, Homo sapiens
ttcctttatcttaagttttataaacattcagatttgcctctgtgctttcattcttttttaacagctttatgagataaaattcgcataccataagattcacccatttaaagtatacaacagtaaggggagccaggcatggtggctcatgcctgtgaatcccagcactttgggaggctgagggtggatcacttgagttcaggagttcaagaccagtctggccaacatggtgaaaccctgtctctaccaaaaatacaaaaactagccaggtgtggtggcacacgcctatagtcccagctactcaggaggctgagtcatgagaatcgtttgaacccgggaggtggaggttgtagtgagccagatctcaccactgcactccagcctgggtgacagagccagactccatctcaaa

SEQ ID NO: 9181 - DNA, 331 bp, Homo sapiens
aagcaggcctaacagcatccagaagccctcctcgtgtttccttccagttactacccctctctcccaagggtgactgctatcccaacttccagcagcatagcctgttttttgtcatttggcatatataaatgaaaaatattatatatactatatatatagtatatatgtataaataaatagtttatatatgtctagatatctcatagtgtatatactgtatatattacatattgtatacactatatgacatgtactatatatctataataatgtagatagtatatatctatatatactagtatactatatacaataaatggaataatgcaga

SEQ ID NO: 9182 - DNA, 337 bp, Homo sapiens
ggatgagcagagattgctagtaatctaggaatgggcaacctagatggctcacaagcgccaggaagaggctctgctaggctagtcatgtgtagttccttctttcagtctcaacaacccgatctagtcagtgcaacataggccatcttgacgcttaatatttttcagatagttttcttatttaccaggaaaacaaattgtcatatttgttcatgtttgtgttctttgatttatcatcatttaaaatatgatattcacttggataaaagaatcagctacaaatacatttttcttacctttctgaaaccaagttggttgctaagatatgaatgagacctgt

SEQ ID NO: 9183 - DNA, 1023 bp, Homo sapiens
aaaaatattggggattgggttattgattaaatgattgacattggcgtgtgccatagaaaatggatcaatacaatatttacctgttttttaaggatcctttgtagtataggtaaacaaactattgtttataaactgtcaataagtgtagaaggtttctcgatgctttaaggttgagtttagcaacagtatgatacatagttgttagtttttgtttagtgatacaaggcagttcctcattttgacagttgccttttcttttttccctaaatcactagctctcaagcttttaaatctcccaaaatgtcccaaatcctgggccacacctttgccacacttctcaaatgagaatctctgggagggccccaggtactgcggtggcactgacagcattgtactgggggctgctggttccctgtcagatgttttaagtcagattggctagcatagtcacagctgctgacggtgtctttattcatggatgctcagtacagcagttgctagtttcaaatagacaacttccaggaggcattaaaaaaaaattatatgactagaaacaggagggaaggcatgcagatagatttgtcttcccatgggaagtaggccatataagttaaatctctctctgtatcatatccttttttactatcttcagagtctttttcactacctgaaattctcttatttgctttgttttgtctccctgcactaaaacaagctgttagagcaggagccccgttcatgccccgtgctgtatccctagtgtctttagcacaacacctgaaccaggaaaggtgctcagaacatacttcatgcatgagtgctaaataagcctctcttctcctctctcctcacctcaggtgatccacccacctctgcctcccaaagtgctgggattacagacgtgagccactgcgcctggctcctgctagatttttggtacaaatgtaataatgtatgtccattcatgataattgggaaaatgcaaaaaaaatagaaatagaaaaagaagaaaaaaatccttca

SEQ ID NO: 9184 - DNA, 421 bp, Homo sapiens
gtctccctgcactaaaacaagctgttagagcaggagccccgttcatgccccgtgctgtatccctagtgtctttagcacaacacctgaaccaggaaaggtgctcagaacatacttcatgcatgagtgctaaataagcctctcttctcctctctcctcacctgaggtcaggagttcgagactagccttgccaacgcagtgaaaccccatctctattaaaaatacacacacacacacacacacacacacacgcgcgcgcgcgcgcgcgcaaaatagccaggtgtagtggtgcatgcctgtagtcccagctacctgggaggctgaggcaggagaatcactttaacccaggaagtggaggttgcagtgagccgagatcgtgccattagactccagcctgggtgacaagagtgaaactccctctcag

SEQ ID NO: 9185 - DNA, 491 bp, Homo sapiens
taaaaattcttctagtgacttttccttaatctacaaagaactcctagaatctatgagaaaacaaaagaatatctcagcagaaaaatggctaaataaaatacagactggctgataagcctaaagagatctttgactttattagtaatcaaagaattgcaaataaaattataatagtattttattttttcactgataagatttgtcaaaattatggaaattgttaaaacacagttttagcaaatatgtggtaaacacacctgtgtactttcggtaggaatagaaattgagtctgggcaatatagtgagaccttgtctctactacaaagaaaaaaattagccaagcatagtggtgcacacctgtagtcccggctactctggagactgagcggggagggttgcttgagtccagatcggggttacagtgagatatgattgtgccaccacactccatcctgggtatctgagtgaggctttgtctcaaaaaaaaaaaa

SEQ ID NO: 9186 - DNA, 675 bp, Homo sapiens
gtttaaatggtgtgggtgattccacccactggtggatgtgagaaccatatgctcagaagtgggtgggatgggagggaggtgtgtacctcctggagggtcggtcactctggttcctgttggctgttcatggcgtgagcatcctgctgtgctgagggtgaggcacatgtttaaatgtgtatttatgcaaagtggtccctaaacagaagccccctacttcctctggtgcctgatggaggaggcagctttctgttccggcccaggaggaaactctccctggatggtgatggggaaacagtacatcaggttccaggcagagccttccttaggagttgccaagggtgtttttgactcattgggtgccataagcattgactgtagaacctaaattccaagaaaggtatgactctgctacttccaaaggccaggagtgggaaaaggcacattccttccttatatcctggaagcacccagatattcttcatgtcccatgggcttagtgtggaggaaaaaaatctatgatcctttgagcattatttagtgctcagttaatacatttattaaatgaatagtttattaaaagtaaacatttttctaaatatatacgaactactttcacaactaaaaaatgaaaaaataaagggaaaaatgaaaataaaatgaaatttaatgcttttt

SEQ ID NO: 9187 - DNA, 1217 bp, Homo sapiens
gtttaaatggtgtgggtgattccacccactggtggatgtgagaaccatatgctcagaagtgggtgggatgggagggaggtgtgtacctcctggagggtcggtcactctggttcctgttggctgttcatggcgtgagcatcctgctgtgctgagggtgaggcacatgtttaaatgtgtatttatgcaaagtggtccctaaacagaagccccctacttcctctggtgcctgatggaggaggcagctttctgttccggcccaggaggaaactctccctggatggtgatggggaaacagtacatcaggttccaggcagagccttccttaggagttgccaagggtgtttttgactcattgggtgccataagcattgactgtagaacctaaattccaagaaaggtatgactctgctacttccatcagcaacgggtacttgtcatcacctggagcgtgaagggccacatgtattgtttggaaggccatctggagcctacattctagtaggagagggaagaaacagatgtagccaaccacagtatgaggtggaaacataaaattacaaagggaaaagaagagaatgacttacagttagatcactggtccttagcctggttgctcattggattcacctggggagtttttagtcgtctcatgccagccccgttgcacccaggaccagtcaaatcagaatctgtgagggcatagtcagggagcatgagtaggagattccagtgtgcagccaaagttgagagctagggaacagatgggggtggggtggagaggcaggccaacaagttgcaagtaattcaaatctccattggaaggggcttctcacagagcaaggcggcagctccagggctctctagtcctttccctcagctatcctctgccactgccatgcagatggcaagatggccaaggcagcccctgccccagcatcccatgctcaggacagtacccaaaggccaggagtgggaaaaggcacattccttccttatatcctggaagcacccagatattcttcatgtcccatgggcttagtgtggaggaaaaaaatctatgatcctttgagcattatttagtgctcagttaatacatttattaaatgaatagtttattaaaagtaaacatttttctaaatatatacgaactactttcacaactaaaaaatgaaaaaataaagggaaaaatgaaaataaaatgaaatttaatgcttttt

SEQ ID NO: 9188 - DNA, 301 bp, Homo sapiens
aattatcattacattatatactctcatagtcaagctacttcttattttttatttttatctcataaaatatcaacaccttgaaatcaagaactgtacttcatatctcttagagtagtaagagagtattaagctcttagagtagatcttaataactatttagctgactgaatcaacctgagtcatattaaattgaattccctctgccatctggtggcatttggctctttggcagagaagactagtctagaagttgtaatcactgaagacaattaagttggtaaacttaatatatatgcatctt

SEQ ID NO: 9189 - DNA, 395 bp, Homo sapiens
tttttttgagacggagtttcgctcatgttgcccaggctggagcgcaatggtgcaatctctgctcaccacaacctccacctcccagattcaagcgattctcctgcctcagcctcccgaatagctaggattacaggcatgcgccaccatgcccggctaattttgtaattttagtagagatggggtttctccacatttatcaggctggtattgaacttccgacctcaggtgatccgcccgccttggcctcccaaagtgctgggattacaggcgtgagccaccgcgcccagctgatgttgtacttttaataggatggtcagggtatacctcactgagaggatgacaatttcaggagaattctaaggagtcaaaggagtgagccatatgtatatgtggag

SEQ ID NO: 9190 - DNA, 988 bp, Homo sapiens
tttttttttgttctgagccaccaacgtaatttatgtctaagaagatactctagagatatggcggcaataataaaatcaaaatttttcttataggccaggcagggtggcttatgcctataatcccagcactttgggaggccgaggtgggcagattacttgagcccaggagttcaagtgctcctgagcaaggagttcaagtgcagcctaagcgacatggtgaaaccccatcactaaaaaaaataaaaaatttttctaatcaactccacaaccttttacatattaaacatacaatgctcaaaaaagattcttcaagtttgtttagatgtctaacttaaaattttctagtaaatgtaagggctagtactgttcctgtacccctaaaggtaatttacctacattcccacaggaaccactgaaagaaccccaacttggagtactgcaacccaaatgttccaagaacatccataattaaatcttcccaagacacatataccttaaacaccttctcatggaatgtcatgaaattcttgaacccactttccaccccctaagccctatctctgtcccatcttcctccttttattaagttcccggaaaaaaacagcaatggagggaccacagggaccaccacacacacctgattaagggaaacttcccttaggctgccatgccccattctgcataagtagagaatgaatctatgttgacagagggaagagaacctaactaaaaaggggaaaggtcaaagaagggagaaaggaattactttagttgatagagaaagtgaaaaatcaaatttatcaggtgcaggttcctatgggccatcatctgagaatataatcatgtctgaaaatttgtccggaacatggcaataagcaaagattgctgttattactgctacattaacaaaaaaaaggaaaataatgtaaataaaactatgtataagcatgtaacctgcattttttcgctgggttcacagtttcttgag

SEQ ID NO: 9191 - DNA, 465 bp, Homo sapiens
ggagagagccatcagtcattctcatctcttgaatttcatggcctcattgcttccttcccacctgtaatcacagctgtgcctgtgtgacaaacactagagtgctagtgatggtttatgggtttcaaggctacagtgttgcagactctgcctggctcccttggattacctagactgggggaagccttaagccctctcatgacgacatggaagtagccctgtggacagctacacatggaaaaactgaggttctcagtcaacaactggtatcaacttgccagccatgtgaatgagccactttgaaagtatagctcccagctcagccaggccttcagatgactgcagcccccacatctggcatcaatcacctaagccttcgagtgggaaatgtacagccaagcccttctagaaaccctgatctgcagaatctatgatcacaataaattactgctttatgacatgaaaaaa

SEQ ID NO: 9192 - DNA, 1277 bp, Homo sapiens
  misc_feature (936)..(936): n is a, c, g, or t
actaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggtttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatttttttggggatggcttctttgagtccaacaggccattgatnttttcaagatgcattccagatgaactgctaggtgagggggaagcttcatttttgttacctgatagaatagcttttcttatgagatatatataatgtgatactatgttggatattttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgttgtcgtatcgtaaaaagaatgtatggttgaaaactcaggaatgttttataaaacaaattatttcacaaaaaaaatccaaaaaa

SEQ ID NO: 9193 - DNA, 482 bp, Homo sapiens
tgagacttaaagggatgcatgtgtccctatacagtggcaaaaactggtatgacagaagtgatgttttaagctatgttatcctttagttggacatacactggacccacagagctagagtacctggcaggctcttgctggacaatgtttgctgaatcagagaaagtgggctttgttggcatttgcatgtgaaatactgtgcacatacctcaagatctttgctgttccccccctaaagctactagctatgctggaaacagtgaaggggtcagccagacctggggtcaccttgtcctggggtcccaagccaggcctcctgtcaggttcatctgtctctgttccacctgcactcacacccagtcttgctgctgagagatggagcatccacatcctgaatcctgcctccttcccttgacacacttctatggtgggtgcctgcccaactttttcttaataggactaaattccaaattaaaaaaaaaatt

SEQ ID NO: 9194 - DNA, 349 bp, Homo sapiens
ctctgggtggttctggcagtcacctgttctcatatgtctactggggccaagcccaggcttggctgtgagtgctcaggtgctgtggggggttcctctcagtggtgttgtatttccctctgagtcaggacccaacccaagccccttaattaggtgactgtgaagagctgccatcatgttcttctcgcaagagagctgtgcttcaggtatgaagtatttcagtgacgggtgaagtcagttttcttctgcccagctcttcttccttttttcttttccccgtgggagagcatcttaaccttggagctgaagatcaaaagcacagcgcaatgaacatatgtcctatcactacaat

SEQ ID NO: 9195 - DNA, 862 bp, Homo sapiens
cgggtgtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccaggtgagtggacatttgcatgccatctttatgaataagatttatctgtggatcatattaaaggtactgattgttctcatctctgacttccctaattatagccctggaggagggccactaagacctaaagtttaacaggccccattggtgatgctcagtgatatttaacaccttctctctgttttaaaactcatgggtgtgcctgggcgtggtggctcacacctctaatcccagcactttgggaggctgaggccggtggatcatgaggtcaggaattcgagaccagcctggccaacatagtaaaaccttgtctccactaaaaataca

SEQ ID NO: 9196 - DNA, 1930 bp, Homo sapiens
cgggtgtgctgagctagcactcagtgggggcggctactgctcatgtgattgtggagtagacagttggaagaagtacccagtccatttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactctgcagagagacttcactgcagcctttccaaggatgcttaccaccaggggacatggcccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatgtggcaggagctcccagggaaaaaggaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactggttaaaacaaccaaacacacaaaccaaaactaaactaaacacaaaaaaaaaaaacgaca

SEQ ID NO: 9197 - DNA, 2496 bp, Homo sapiens
gtttctgaaagtgaggttctgagaccagccacttcagcaacacttgagaacttgttagaaataaaagttctcaggctctaccacaggccaactgagtcaggaactctagcagttgagcccagcaatctgtgttttcgcaaggcttcccagtgattctgatggccttcacatctgagaagcattgtcacagcgaatcatcctccaaacaggactgcagcagtagcttcctctttattctgtaagacatggcttgcagttttcctgaaatggagtaacctcactcaccgcttgagtcttggctctccttctctctctatgcagggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactctgcagagagacttcactgcagcctttccaaggatgcttaccaccaggggacatggcccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttggtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggactaggtctaccttgatcttgaagattcccttggaatgttgagatttaggcttatttgagcactacctgcccaactgtcagtgccagtgcatagcccttcttttgtctcccttatgaagactgccctgcagggctgagatgtggcaggagctcccagggaaaaaggaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactggttaaaacaaccaaacacacaaaccaaaactaaactaaacacaaaaaaaaaaaacgaca

SEQ ID NO: 9198 - DNA, 1765 bp, Homo sapiens
agtgttattgtgtgttctcagtttaagatagcagatcatctcagcagtaagcacactgacagaattgagttccagaaaggaagcagtttcaggttcttagcacatgtccaaatccatgcaagtgggagaaagttccaatgcacactttccatgcttccgagtctaggtctcgtggtgaatattcagcaatcattcatgagaaagaatgtattttgttgtatgacagaagggtttaccaagcaaactgtggtaagcatagtatcgaatatgttgcatgtccattttagaaaacagagcccagtcatcagctaatacaaatgatttcccagagcagtgtttgtttcaagcttctgtcaaatagtttggcttttctgcagggtccctgtaacttccccacaaatgtacttctttgttaattcacttattgttatggtgtggctcaggaacaggtctcaggatggagagcagcatacaacctgaacaaagctttttcttgtgctctgaagggtcctgagacgtgagggggatgccttccatgaggatttttatctcagtgaagtgcgagtggtacccacctgtattgtcgttaacatgattattggcatgtttttgactctcatttttcacaagggtgcagtggggccatggaccatcccatgggatggtccataactgtatgttatatggaaatagtgtgggaataatgggttttccatgaaaggttgtgatgcttctggagatgggggcataaacgtgttcattcttgttgagcagcattgtgttaaaccaaattgtgtgaagtggaggtcacctggaccactcctgggaaatgctccagaacaccagtctgttccttctagaaatttgttctctgtatttatttttattttttattttgaggcagtgtctcacccatcctgtctcccaggctggagtgcagtggtgcgatctcggctcactgcaacctctgcctcctgggtttaagcaattctcctgcctctgcctcccaagtagctgagattacaggcacctgccaccacacctggctaattttcgtatttttagtagagaaggagtttcaccatgttggccaggctggtctcaaactcctgatctcagttgatccacctgccttggactcccaaagtgctgagattacaggtgtgagccactgtgcccagcctgttctctgtatcttaaatcaactctgtgccaaagcagttctgtcccctgactcccacccctacccaccaaaaagtggtagacatgaagggcaggtaagggaacagaaaatgtctccttgcagctatatatattttaaacgaactgtgtaataagtatgagctaaggagacagaaagacagtagatgagaaaagaagagtacctatacctacaaggggcaaaatgaatgcaatccttcatttgataagagagaactgaaagagaatattatttttctacaataaagcaagctgtcctctcaggataaagtggaatttcgacatggattatggacttcttccaactcccattgacattgcttcttaccacacatggggaagggctgcctttcctgaaaggggaagaaggcactgtcctttcagacaaagtttgtacaaattcctgaactgcagatttgctaatgtgaccgcgtatacttatattcataatttaagtgattgtttatggtcagatacatattgttaaacttgaaaatgttttattacattacatcaaataaagtctatttgtagctgaaaaaac

SEQ ID NO: 9199 - DNA, 4558 bp, Homo sapiens
  misc_feature (7)..(9): n is a, c, g, or t
ggcacgnnngccgcgtccggggccggctggtgcgcgagacgccgccgagagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9200 - DNA, 1575 bp, Homo sapiens
  misc_feature (7)..(9): n is a, c, g, or t
ggcacgnnngccgcgtccggggccggctggtgcgcgagacgccgccgagagtggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctctcctttctcacccctgtgatttggaggtgtggagaaggggaagggagggacagctcactgtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9201 - DNA, 387 bp, Homo sapiens
tcatgtcttctctttgaccttgttagcagggtcctcaggactttggggctggttagagtgcgagaagcagtgtgttgggtgggccccttgtttgtgataagagaagccaagatgtgtgtgtttccaggatccatccctttattgattctggcagcttgtgtgagtagggatctggctttcaaaacccaccttaaggccagggaagggaaacaatcagactccctcgttcttgcctttttaacatggggtatatatagcacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9202 - DNA, 343 bp, Homo sapiens
  misc_feature (343)..(343): n is a, c, g, or t
gcttggagcctctcctggtctcacccacaggcctggaagaatgcaactctggccgagcaggctaagctgcccgccacagagaagcctgtgttgctctccaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggtgagttggagcccatggttgagcacgtggatgttgcattagcccaggggtaggcctggcaggcacgcctgtttn

SEQ ID NO: 9203 - DNA, 4637 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9204 - DNA, 4760 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctctgagtgctctgttggggaaggtggtctcggcaacgctgctgggctcctcattggtgtgtgttcctgattgtcctgccttaatgcctggctttccttggctccaactaccttccttcccctcaggcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9205 - DNA, 5037 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctacaaaaaaaaagaaaaaaaaaaaaaaaaaaaaaaagggggggacgccaaaaagacttcaccggaggggccaaagaaagaggagacacaagctactgggcaacaagggggcaccaaaaagaggaccgcgaaagaaaagaagagacagggcggacagctaacaccaagtgcacacacgggggaacacaggctgacaacggagacaacacgggggagcgagacacacaaccgcggcgagaggacacctcatgtgtggcacaaaacacactgagagaacttaaaaagggccctaaggggaacgcttaacagatctcacaaccgtgatatagtgtttcacagaagggggaaattgtcggggctgtaaaaggtgtgccatacggataatattttggagaattttatcag

SEQ ID NO: 9206 - DNA, 4989 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggtgagttcaggatggagccagggaagcatggaggacggtgggggatgcaggtagtagccgcagaggaagggggtgagggtaggccacccctgcccctgttgtgttaaccattcactccccaggatcctctgggctctgagctgtttcttgactggtgctcccaaggcccattcccctcattgcagatgctcttcctttgtccagctagattgccacagtccaagcaggccattgaccgtttccatacagcagtcacctgtatggaacccccatggggtcggcggtgccgagccaggcctgcctggaggctctgctcctgatcgttccctggggcgcctgtggtgtttcccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9207 - DNA, 3319 bp, Homo sapiens
tacgagtccaagggcatcaaggctcacttcaacctggatgagagtggcgtgctcagtctagacagggtggagtctgtatttgagacactggtagaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9208 - DNA, 2849 bp, Homo sapiens
agcggtgtgagtcgatgagcattgggcagtctgattctgcaatcatcagtgcctgggcatcccctgtcgcttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9209 - DNA, 4257 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9210 - DNA, 4576 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9211 - DNA, 4359 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9212 - DNA, 1897 bp, Homo sapiens
tgctgcggtgactctaaggatctcccaggtagacctaacactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9213 - DNA, 3924 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggtatatgccgaggaggaggcacgtgaagatgactgtgca

SEQ ID NO: 9214 - DNA, 1330 bp, Homo sapiens
  misc_feature (15)..(15): n is a, c, g, or t
  misc_feature (23)..(23): n is a, c, g, or t
ctcgtgcaatttcgngcagcgtntctacgagtcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9215 - DNA, 3023 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgctcaggtaccagctcggttcgtaa

SEQ ID NO: 9216 - DNA, 2310 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9217 - DNA, 746 bp, Homo sapiens
acctgcacctctacctccctccccaccacacagagaaagagcatctacaagccaggaagagaagcctcacacagaaaccaaccctagacagatctgtgagaaaattctgtcattataaggcactcagtctggtattctgttatgggagccccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9218 - DNA, 2621 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggtgagttcaggatggagccagggaagcatggaggacggtgggggatgcaggtagtagccgcagaggaagggggtgagggtaggccacccctgcccctgttgtgttaaccattcactccccaggatcctctgggctctgagctgtttcttgactggtgctcccaaggcccattcccctcattgcagatgctcttcctttgtccagctagattgccacagtccaagcaggccattgaccgtttccatacagcagtcacctgtatggaacccccatggggtcggcggtgccgagccaggcctgcctggaggctctgctcctgatcgttccctggggcgcctgtggtgtttcccaggaggaagaggagagccctgcagaggggagcaaggacgagcctggggagcaggtggagctcaaggaggaagctgaggccccagtggaggatggctctcagcccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9219 - DNA, 761 bp, Homo sapiens
tacgagtccaagggcatcaaggctcacttcaacctggatgagagtggcgtgctcagtctagacagggtggagtctgtatttgagacactggtagaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9220 - DNA, 405 bp, Homo sapiens
cggcacgagggtgcccagggcaccttcaagcccctgtcaggagaagggtcctgccagccatgcccagccaatagccactctaacaccattggatcagccgtctgccagtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggtgcttggaggggttcttaaattatatttaaaaaagtaactttttgtata

SEQ ID NO: 9221 - DNA, 287 bp, Homo sapiens
caagtctgcacacaactcctcaaattccacacgagtcacttttgacttgaagtccacatcatccatcaggccttcaatctgtgccatgtggtcagcgttggcactgaggacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaagtgagtgtgggggctagagcgcttggctgagtt

SEQ ID NO: 9222 - DNA, 4547 bp, Homo sapiens
  misc_feature (14)..(14): n is a, c, g, or t
aggttggtggctantgtaacagtttgcaaaccgagaggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9223 - DNA, 3775 bp, Homo sapiens
tggacttcaaggcaaaagtgactcgtgtggaatttgaggagttgtgtgcagacttgtttgagcgggtgcctgggcctgtacagcaggccctccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9224 - DNA, 3349 bp, Homo sapiens
gggtactctgaggatcccggggcatggggttgtacagcaggcctccagagtgcggaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9225 - DNA, 4657 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctacaaaaaaaaaataaagtcgagc

SEQ ID NO: 9226 - DNA, 3045 bp, Homo sapiens
tgtcaagtctcctcaggtaaagtaggcttggctccctgaccaataatcggtcttccactctcccaagttcctagtaagattcacttatgaagagaagaaacggtctcaagttacgtgtgaccactacgcttgaactctgggaaccttcaatgtattactgagaccatgaaccacaaaaataggtttgagtgaggtgtgagctagacctttctggaggctgaaagcattcacacacacacccctctgctagttacatggacacagacctgagcaagccaggcctggcttgctcaggtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9227 - DNA, 4591 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9228 - DNA, 1840 bp, Homo sapiens
gcttggagcctctcctggtctcacccacaggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttttttgccacattggcagagatggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctaca

SEQ ID NO: 9229 - DNA, 4411 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggaggaggg

SEQ ID NO: 9230 - DNA, 3141 bp, Homo sapiens
  misc_feature (117)..(117): n is a, c, g, or t
  misc_feature (3114)..(3114): n is a, c, g, or t
  misc_feature (3136)..(3136): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagggcatttcagaaccgaggatcctcgngggtcttccaaagaagtttcanctaac

SEQ ID NO: 9231 - DNA, 3292 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaacgggggccccggctcatcccagagatggaacacgatcttcacttgaacgcgtggagatagacacaccgctctcgaagcaacacgtcactcaatgagaccctgggggcctgcgaaagaactgcacacttctgcgacccgaagcaacggctacggatggcccgggcacacacgcacacccctgcagaagcaccacaaacagaaacacgaaggcaacaaatagaaagcgccccgggacccgaacacgaggacgcaactggagcgaccacatcggcccaagagagcaccaaagacggccgagagccgcgacccaaggaccaaaaaagagaggaacccggggaaccagaacatcgccccgaaaagacccgccggggcaaagaggcagcgacggagaaaggggaacacgagccgaagagggatgacaacaggaggactgtgagcacccctcgagatgagcagtgctgacatgatagcaaggtcatcacggcacactggaaaagatagaaggggtcttgacaaggacagcgaaggacgagaacggacgacagacacc

SEQ ID NO: 9232 - DNA, 1901 bp, Homo sapiens
  misc_feature (117)..(117): n is a, c, g, or t
agcggaaggggtagcgggggtggatggaggtgcgggccggccacccctcctaggggagacagcgtgcgagctccgggggcgggtcgggagcgcaagggagggccgcgcggacgccgngcgctcggcctcgcaccggggggcacgcagctcggcccccggtctgtccccacttgctggggcgggccgggatccgtttccgggagtgggagccgccgccttcgtcaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagctggttggacaggtttgagtcaaattgtactttgctccattgttaattgagaaactgtttcaataaaatattcttttctaca

SEQ ID NO: 9233 - DNA, 312 bp, Homo sapiens
tctttttttttttttttggtgtctgcactccccaccgtatctgtcccttcctctttctcccattttgagggatattataagggcaacagttttatagtctcaatattgagggtaagactggttaatagatagagtatccaaattgaatttattaaacacagttctgtgtgcatttccttctgcaaatctgagaataaagtgattacagtttcatcctaaaatactttaaaaatcagttggttttagaaataggtttttttccttttgcatgtaagaatggacagctatttttaggaaggcatgcacctgtta

SEQ ID NO: 9234 - DNA, 450 bp, Homo sapiens
tgtttactgcctacaaagggtgggcattcagatatgggaacaaatggatacacatgtacatgaaaatttgtgtcaagtgtgaaatcatctttaaaccatctttctcccctacgaacactctttaaagaacttccttttttcctactttctatgacaatctttaaagagcttcctttttataggccacgcacagtggctcgtgcctgtaattccagcattttggaaggccgaggtaggaggactgcttgagcccaggagttttagaccatcctgggaaacaaagagagtgacccctagatgagtgtggtgatgcaagcttatagttccagctactcaggagactgaggagagaggatcccttgagcccaggaggtccaggctgcagtgagctatgattatgccactgtacttcagcctgggtgacagagaccctgtatttaaaaaaaaaaa

SEQ ID NO: 9235 - DNA, 462 bp, Homo sapiens
ttgtatgctttttaaaaacatggttttacttttaaaacacattttatatgttttattgtgagccctaaatgtcttcataaatggacttgtacctaatgcaatcttctttcctattccttaagccctggtaggaactattggatccttttctcttcttctctttcttctttttttactgcttccaaaatcacctatgcagtttgggagcagaggcctgctccctaaagaagtcagctttgctttggaagcagatttatgcctcaagccaaatgaagagaaacaggaacggagagactttgtgtcctttttcttcagccaagttccttgcaacctgtttgttattcttggagccagaaagagagtaaagtactttgcataatggaggcaaatactggggatggatcaggagcagaccttgttctagacctgatttttaaccgggtcagttctgagtcaggcaat

SEQ ID NO: 9236 - DNA, 567 bp, Homo sapiens
ggcttctgacccccagaagtcctaccttttcccctgctcagtccttatctattttaggcatttagggaaaacaccctaatcagctgctggtggctgagatccaagagaaactcagcttcctctttagtgggtgcatcagggttggggctccttaggagcacctggcatatggcagccccccaaacaccttttcagggggtagtttgcatcgtcttccccttcttgcttctggctgcaaagtggttcctatcacctctcctcacacccttaagttctcaaggttactatgggctactcctgttgcggtttaggtttggttgttgacttgggccagaggttgccagtttgtggatgtgtgtgtggctgcccatggcctgaggctgcacccacccatgttggttgtggcaagtgtctctgactgattaagggcaaaaacgagcagggacttctcacatttgccttaactgtcacagggcctcagctgggttgtctgctctttccttcctggatcattttcccagcccttagttcccataggaaactttctctcaaataatgatttctgct

SEQ ID NO: 9237 - DNA, 679 bp, Homo sapiens
catagcaggcttcctggtgtagctggcaccacatccctccctgacacacggcctccttattgcccctgctacttgcctttttctctcctccctttccttcccttcattccccctggcttccccttcccaactctcagaatccctggctgcctcaaccacaagaacaaagctgtgcagaagcctgaacctggagcttctgcaagatgaggtggggaatgagctaacccagctggaaagcagcctgctgatccctgggagagacggcgcttgggccaacccaccctccccaaggtggtcccctgcctcagctccacccgcttccccagatgaacttctttctctccctccagcgcttcagaggatgcacagctgtgtgtacttgaccctgagcctgggctagtgctggggacatagccagtctggctgatacccatatcagtacagaaagctgtcctcacccacttcatgcactagttgcattggtatgaagcattagctttataactatcccatttactgcaggcataaacctatatcaattggtggggatggaggttaaatgagagaagacatcaaagatgcatagaactattgggcccctttcaattaataaataaaatttgtaggaggccattagtttgtactgtgctcctgtaatggacccaacagaccaaacaaa

SEQ ID NO: 9238 - DNA, 296 bp, Homo sapiens
caaaaacaaaaacaaaaaactccaatagcaatatcttacatctctgtaaaccctaggcctagtacagtatcgtgacaatagtgggcatataataaatatttgttgatgatgatgatggtaaaagctgcaatattaagtaaattcagtgagagaattcatgaaaattgcaagtatctagtgaatattggaagtaggatatctggggcattagagtgagaagagaggatggagataaataggaacatgaaaaagaagagaatactatatataagagaatgagttgcttcttgattttg

SEQ ID NO: 9239 - DNA, 459 bp, Homo sapiens
ggagatgctcactaggcagacagaatcagccaccacagcccactccctcagccagtattactttgactaagttagtgaggaaccaggccccagattaagaagcagaactcacactgtcatctgctgtgtgcctggctggctcatgcataccttgtctatctaatgtggaccaaagccctgtggcacaccctgctggttacccccagtggttaccctggcacagaggaggaaagggagtcgtgggagggagaaggacttccctgggaggtctctgggctggcaagttgggtgacacaggtccggttggctgcaacctggggctctgctgttgtaatcataaatgtgtgtgtgtgtacagttgtttacaatgtcagcatgggtgtccttgtttgttagagatacatgccactgctcccatcatgaggaaaatcccaagccctccccatgatttttgccagt

SEQ ID NO: 9240 - DNA, 2082 bp, Homo sapiens
ggcagcaaaaaaatcgtttctgagaacgcatcccactgaatttagaataaaagccaaactcttagaacctatgtagtggcccttactgacctctcagacctgatttccttcttcctcactgcagccacaatgactctcttcttgttccagagtgttcccaccccagggcctttgagtctactgtcccctccaccccgaatgcattctgactccactcaagtgtcactctccaagagccaagttgctcccctgtcccctgctcttctctgtctatgcattcttttatagtgcttaacacagtctgaaatagtctcgcccctgtgtgtgtgttgtctgactccccctctagaataccaggatccttggaggtgagggagttcctgttttgcttgtggctacagctcagccactggaatcatatctgacaattggttggcatcagtcgcaactctgggaatgagggaatgaggactagagggggctggacgggcccagccacctgccttcatcattgtcatttctctttatcactacggtaactcctccttcccctcatgactttggaagtcattcagcagccactccagccccaccaacctgcccctatcccagaggggcctgggatggagggagagaaccactgaggcccctccacatccctgcacccgctgtgcccatgggggcggagaacacatctgacccggctctgagggagccgtggcctctctagggagggctggcctgctggtgagacttcactcataatacaagataattataccagagttgtcatgaggcggtggtgattaattgctgtgcgtggggcacggacggacagcgaggtatagagagtggagagaaggccgcagcccagctgggcttccaggtgggagctcagcctccccatctctgccgtggaagggactcagaggtgtcaggccaagcatgcaggcaggcttgtgacaaactccttggccaggagctctgagaattagcttcacttccctcagaaatgccccaattccctcctggaagaggagctgtgtgacagctcaggccagggggtcgggactccccccatctcctccgcacacacatacccctgcacacatacccagccacgtacagctgggtggctgtacgcaagtcatttttctactctgagcctcagggtcttcctctgtccacctccccccaggattactggcagaattaggtgtgagcttgcatttaaaaagaggtttgttttgtaaacccaggctttgcaaattggcagcccaagtctcaggggcctgtgcagtgactgatcattaccaacatttcgaagtgagagatgtcacataaagagcgtcatttcgagcttctcttgaaaagttgtaaggtgagctaccctgggactgtattcctgaatggcaatgtgatggcagagtcctgcagtattaccacctgtggacttgtgcaccagggttcccacccacccacttcaggcccttggttcagggatgtgcccgtcatggaaataccaggtgctgtggctctgctggttttggctttccttctctgtaaccttccaatatctttctccttccaggtactgtaaaccacttagtaattaattagttaataaattcatctcatcagcacttttaaataatgtgctaggccacactgtcatggaccccagatatacagcagcaaacaaagcagccatggtaccttccctcagggagcagtcagtccagtggaggagtcagatatgactcaccacacagatcgaaaaatctccacaaattatgagaagaatgctgagggaagaaagaacataggtggaccgctgctgagtccaggcttacttgcagagatctatgctggccaggccctgtgctaggcagcagaggacatggaataaaatcaaataaggtcactgtgtgcaggcacctcacggtgtggtaaaggagcagccccatccacaggttctattaattccagcctgtgagaattggaaccacagggtgaattttggaggacaggcacttacactaatctggaagcataatatataaagagtacctacaaatcaat

SEQ ID NO: 9241 - DNA, 2691 bp, Homo sapiens
ggcagcaaaaaaatcgtttctgagaacgcatcccactgaatttagaataaaagccaaactcttagaacctatgtagtggcccttactgacctctcagacctgatttccttcttcctcactgcagccacaatgactctcttcttgttccagagtgttcccaccccagggcctttgagtctactgtcccctccaccccgaatgcattctgactccactcaagtgtcactctccaagagccaagttgctcccctgtcccctgctcttctctgtctatgcattcttttatagtgcttaacacagtctgaaatagtctcgcccctgtgtgtgtgttgtctgactccccctctagaataccaggatccttggaggtgagggagttcctgttttgcttgtggctacagctcagccactggaatcatatctgacaattggttggcatcagtcgcaactctgggaatgagggaatgaggactagagggggctggacgggcccagccacctgccttcatcattgtcatttctctttatcactacggtaactcctccttcccctcatgactttggaagtcattcagcagccactccagccccaccaacctgcccctatcccagaggggcctgggatggagggagagaaccactgaggcccctccacatccctgcacccgctgtgcccatgggggcggagaacacatctgacccggctctgagggagccgtggcctctctagggagggctggcctgctggtgagacttcactcataatacaagataattataccagagttgtcatgaggcggtggtgattaattgctgtgcgtggggcacggacggacagcgaggtatagagagtggagagaaggccgcagcccagctgggcttccaggtgggagctcagcctccccatctctgccgtggaagggactcagaggtgtcaggccaagcatgcaggcaggcttgtgacaaactccttggccaggagctctgagaattagcttcacttccctcagaaatgccccaattccctcctggaagaggagctgtgtgacagctcaggccagggggtcgggactccccccatctcctccgcacacacatacccctgcacacatacccagccacgtacagctgggtggctgtacgcaagtcatttttctactctgagcctcagggtcttcctctgtccacctccccccaggattactggcagaattaggtgtgagcttgcatttaaaaagaggtttgttttgtaaacccaggctttgcaaattggcagcccaagtctcaggggcctgtgcagtgactgatcattaccaacatttcgaagtgagagatgtcacataaagagcgtcatttcgagcttctcttgaaaagttgtaaggtgagctaccctgggactgtattcctgaatggcaatgtgatggcagagtcctgcagtattaccacctgtggacttgtgcaccagggttcccacccacccacttcaggcccttggttcagggatgtgcccgtcatggaaataccaggtgctgtggctctgctggttttggctttccttctctgtaaccttccaatatctttctccttccaggtactgtaaaccacttagtaattaattagttaataaattcatctcatcagcacttttaaataatgtgctaggccacactgtcatggaccccagatatacagcagcaaacaaagcagccatggtaccttccctcagggagcagtcagtccagtggaggagtcagatatgactcaccacacagatcgaaaaatctccacaaattatgagaagaatgctgagggaagaaagaacataggtggaccgctgctgagtccaggcttacttgcagagatctatgctggccaggccctgtgctaggcagcagaggacatggaataaaatcaaataaggtcactgtgtgcaggcacctcacggtgtggtaaaggagcagccccatccacaggttctattaattccagcctgtgagaattggaaccacagggtgaattttggaggacaggcacttacactaatctggaagcataatatataaagagtacctacaaatcaataaaaaaaatagaaaaacaaagagcagagtatatgaacagaaaattcaatgaaaaggaaatagaaatggctcttaaatgaatgaaaacatactctcactcagagaaaatgaaaatttaacccatgtcaagatacttggggtgaagggaagtgttataaaattcgattgtggtgatggttataaccctataaatttactaaaacttattgaagtgtacctttaaaacaaatgaactttatagtatgtcagttatatcacaataaggctattttaaaaataaaaacactttgagataccattttatacctgttggtattagcaaatgtcaaaacactggataatgcattatgttcctaaaggcatgggggagacggcctggggcaagcgtccactgatgcattcttgggttggggtgggcaacaggacgctgtcaaacatacaaatacatttacgctttgagctgggaattccactcataggacttcatctgatatatatgctttacatctgaaaaatgtataaggaaattcaccacagcctcatagattatggcaaaagtttggaaacaaaagatgtttgtctacaggtgaaaggttatgccactgtcaaa

SEQ ID NO: 9242 - DNA, 1464 bp, Homo sapiens
ggaggggtagcattaggagaaatacctaatgtaaatgatgagctgatgggtgcagcaaaccaacatggcacatgtatacctatgtatgaaacctgcacgttgtgcacctgtaccctagaatgtttggaatttatgcattttccatttttttaaaaaagtggtttatttttattactttctttttgtatgtctaaatgatgagataaaacagaagggttcagactgctgtatgcaagtgacattctgcaaatattatgatgtgggtattgctggtcttcatttctaataacaagaggccaaatcggatctaattgtcactattttctctttatgactttggtttcagagatacaagagacattgtgatgagccatataaacagtctgatgggctgaatgcaatttgtaggtctagtgaatgaaaatagtcttggttcaaaatcgtagaattatgattttatggtcctcatttactttattttatttttactttattccagcaaacgttttatattttctactttttgccagcatttcattatgggtatatattaagcaccatatgactttttaaaatattgctgtagagtagtcaaagctcacatgagacgccacccaagcagctgtcatatgaatgcatatctgttgttcaaggaatgtatgcttcatgtaccggtgagcatgcattcagaggcttccaaagtgtttccattttaatgggtagtgggggatgctaaaggattattttaattgttatttttccaaatggaaatgtaaaagagtccactgccacgtgaatgcaacactgtagaccttcctgaatgcctttcagaaccccctccatttggcagtgtctgagctcccctcctgtcctgatagtccatgatgctcaccagcaccccctgggaaaatgaccccttattttctcttaggaggagaaagatgtgtaggtcccaaggcccatgttctagggaagtgtgatgcagatttgaaccaattacacatagaggggaacatatgataatttgagggatcacatcaaattatccggattgacaccaaaatgaagaagtggtgagagcctgtcagataagaaaaattttaaggactggtaatgtccagtgttgatgagagtgtggggaaatggatactctttagttggttttgcttttaagatagtttagcagaatctgtcaatgttttaaatgcatgtatcttttgacccagcagtttctataggattctctcttacagataaacccatacttgtgaacaaatataccatatttcatcgaatctaaaacaccctaaattgtaaagtgtgctattattttatgtaccattaagaaaacaaaatgtgctattattttatgtaccattaagaaaacaaaacccaccttttttttttaaaaaaaaaaaatctaaacaaaggataattttaaataaaaacacattatataaaaaa

SEQ ID NO: 9243 - DNA, 421 bp, Homo sapiens
acggtgtacttaccatagccaggcgctacgctgagcttttcacgtgtgacacctcactgaatcccccaaccatcctagtcagcatgtattattattcccattttagagacgaggaaactggcattcaaagagcttagatacttgctggagatccacacctcgaaagtgtagaaccaggtttttctgatgccagaagctgtttctaaatgctctgctgaactagctctgcaggaacagaatttggacaaggagatacaggagcaaggggatggggcattttaggttcttagaaagtgagtggatgcgtgttgggaagccagtacctggaggctgtgtctgtgcacggaatttacagcctctccaaaccccttcccaggaactggatccgccagtacccagccttggtgaactgcacaaccat

SEQ ID NO: 9244 - DNA, 3954 bp, Homo sapiens
ctctgccagggaactggcaagcaacaaagaaggtggtgattggctggattcttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggaggagattgatgcaataggacaatttccaatttaatttagatcctctaatctttctacatggacaagctgttttcttttctaggttactgataacccctacaattttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgacttactctcaataaaaaaaaaaaaaaaaaaaaaaaaaaaaaaaaaagaaaaaaaaaaaaaaaaaaaaaaaattgcccgcgtttcacacgttggactggaaaccctgcgttcccacttaatgcttgagtccccttcgcagttgggaataccaagagcccgacggacgcctttcccgttgccacctgttgc

SEQ ID NO: 9245 - DNA, 3900 bp, Homo sapiens
ctctgccagggaactggcaagcaacaaagaaggtggtgattggctggattcttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggaggagattgatgcaataggacaatttccaatttaatttagatcctctaatctttctacatggacaagctgttttcttttctaggttactgataacccctacaattttcgacttaacttcatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgacttactctcaataaaaaaaaaaaaaaaaaaaaaaaaaaaaaaaaaagaaaaaaaaaaaaaaaaaaaaaaaattgcccgcgtttcacacgttggactggaaaccctgcgttcccacttaatgcttgagtccccttcgcagttgggaataccaagagcccgacggacgcctttcccgttgccacctgttgc

SEQ ID NO: 9246 - DNA, 3943 bp, Homo sapiens
agcgggtctctactgccaaggtgctaatgccgaacccctgtgggatctctggtccaaggaaacatctgcacacaggccaggatggcgcttagcttcatctgtgctgcaaactctcatcagtaggcttgctggctctgtgaccttactagctgaactccttaatctctctgcacttcatttttctagtctataaaatggagataacaacagcacctacctcagaagactgttatgaagactctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggaggagattgatgcaataggacaatttccaatttaatttagatcctctaatctttctacatggacaagctgttttcttttctaggttactgataacccctacaattttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgacttactctcaataaaaaaaaaaaaaaaaaaaaaaaaaaaaaaaaaagaaaaaaaaaaaaaaaaaaaaaaaattgcccgcgtttcacacgttggactggaaaccctgcgttcccacttaatgcttgagtccccttcgcagttgggaataccaagagcccgacggacgcctttcccgttgccacctgttgc

SEQ ID NO: 9247 - DNA, 439 bp, Homo sapiens
aaagaatccccttgatgtgaatcagtatccaccaggaaaaaaacaattaatcaaaaactgatcatttaaaaatcagtcactttaattccctcatttttacagtaatacaaagtcagaacaggaaagatacctacttgggttatattttcaaatctaatagtcactgctcttaaactccaaaatgtacccgtatcttcaaatacccttgaaatatgcaactaccctaaagaatatttagttcagaaagcagtacagaaaggtctcaatttacaagagagacaaacaagcactgactttagacaactcaggccaaaacaagtcaagggtatgatgtgcacaacgatctaactgaaatgacacattttccttactaattaaattaggaaacacttttgtgttctacttacactctgtaacactgaaaacacaaacatgttta

SEQ ID NO: 9248 - DNA, 429 bp, Homo sapiens
agtgtggttgtagactctcagaaggtcttcaaaataaatatcagagggatttggaggaggtgacaaagatgaccaaaatatgagttagcccaatataacacttgcaagtctctaaaaatacagttcatgatgatgcatcttgagtgcattggtggcagtggagggtcagaatttctgttaggtttcatttgttttaactctcctgaagttgctggtaaatcagaagaattttaacatggaaagagaaaaaggaaaggagaataatcagatttatgaggccatttggcaggccatgcgtcccaggggcagagatagctttacagcaagaactgacagtaatttctagtaactctcttaagccctcaaatcccccaaacctggttgtatgaagtagtctctctttaaaataaatgcctgaaagaaatctta

SEQ ID NO: 9249 - DNA, 504 bp, Homo sapiens
tgcaccatcaaggtgaaatcatggaaaggtaaaagtaaataatatgcctgtttgagtgcttagattatcagcaggaattgggccctcatgaggcatctggttctgagcacagtgggcatgaccctggcactcagagagcatacaatcctccttggcaattaaaaccaatatccaaaacacagagatcttaagccctcagttgtgtttcactgaaagtaaggttcctacaggcttggagaagggaggtaatggagaagtgctccctaaagtgtggtccatggaactgctctgccaaccatttgttgtcagtcagtaatgaggagcacagaaatagaaaggaagcatttagaaactttatagcaatttgccagagtaattttatgtctgttgaatctaaaaattaaaaaattggaacttttgtttttaaaattgtactttgctggtaattcattttcattatagtttactaaagtactagtctataacagattagaataaaagcag

SEQ ID NO: 9250 - DNA, 510 bp, Homo sapiens
tgctgggattgtaggtgtgaaccaccgtgcccggccagaattagatgattttggtgatgcaaaataatctatgtcctgacccccgttctttttaaaataaacttttagttttagcgtagccttagatttacagaatattgtgaagatagtagagaattcccacatatcccatatccaatttcccctgttattaacatcttacattaatatggtacgtgtatttcagttaatgctaatgtccatactgtattcagattttcttagtttttacctaatgtgcttttgctgttctaaggacaataggtaaaagctaaggctctcatgcaggataccacactgtatttggtcattgtgtctccttaggctcttcttggctgtgacagtttctcacactttcctcgtttttgatgaccctgacagttttgagaaatacaggcatatgctggtgatactgtgggttcggttctgagccactgcaataaagggactatcacaaagtgaatcacacac

SEQ ID NO: 9251 - DNA, 557 bp, Homo sapiens
attgtcagtatgccaataccctatgcgtgaagctgaggcaccagaatgatttgctgtctactcaacatctcccttattccacactataagtaggtcccagaagttctttgatgggacaaaaagaattaatgccaaagttgaatgagttacagccgctaccacctaattaaaatgattttgtgccagttgcttttgttgggcaagatccacacataatataattttaatcctgtttatatgcactcttgggatagatttgagatcagcattgccatttaagtgaggttaatcaagcatactgtatgcagcttttgtttctccactgtatgtgaaaggtgaccattgctgacaggttacccaactggccgcttactctattaacaagaaggaggtggttttcagtgtctggtcattaacctagcctcagccccagtgactcttttcgcctagtccttggaatagtgcagctgttgtcagtcgcagaggagaactctagttatgaaccgctttgctttggctgcagcgacatgcctctacacaaggagggggggagggag

SEQ ID NO: 9252 - DNA, 444 bp, Homo sapiens
taaacccagtaaacactcattaaatgtcttttgaattaatgttcatttgaagatacattagtaatacaacattatggaatgatgatacagtttttcttttggagtctggtttttaataggaagcaaagtctgggggctgggtgcagtggttcatgcttgtaatcccagtactttgggaggccaaggcaggaggatcccttaagctcagaagttcaagaacagcctgcacaagatggtgagaccctatctctacaaaaaaatttttttttaattagctgggcatgctgctgcgtgcctgtagtcccagctacttgagaggctgaggtgggaggatcacttgagcccaggagtttgaggctgcagagtgctgtgattgcaccatgcagagtgcctttacgccatggcactccagcctgggcaacagaacaagatctcatctcttaa

SEQ ID NO: 9253 - DNA, 478 bp, Homo sapiens
ccagcctaatggccatagtgccctgcatgggtaggagttcccctccctgagagaagtctgggcattagcactttagtgagcttcaaaaatctagtcagtcaactccctaactaggtaccagtgaagatgcactacctgctagcattttgcaatagttttatccactcatgcgaggttctgtgtagggacaacccatgtaaggcccctgttttacctactatggctgcatcaaaatcaacacaaacttagtgatttaaaagaactatttatgatattcgtggatctgtagatcagaaattggggtggggcacagtgaggagggtgtctctgctccacaatgtctgggtgttagctgaatgacttgaagacaggggctgggaccatctgaaggttcagtccttcccaagtctggctgttgactagggctttagctgaggctctcatccagacatctacaaacagcccgtccatgtagctg

SEQ ID NO: 9254 - DNA, 797 bp, Homo sapiens
cactcactcatcaatttctttctatcctggtttatttctcttcataacacttattactataagagataaatacattttatcatccatctcctctccctagaatgtaagctccataaggacttctgtttattgctataaacccagtatctacaacagtatctagctcactgaaggcactcaaggaaagtctatcacacccaaccacctcaccgtcccccaacctccatccctattcctattcatcctttaaaatcttattcaagtcattacctcctgtttgcctttcctaaattctgcaattaccccctttccctatgccaaatcattcccatctctagattttgaaaatgcttctactattgtactatgtatattacactgtgaaagaagatttttttaagaaaagacaattatcgccactgctaggcttaaagcccacctagggactttaaacttcttaaaattttatattctcaggatccaacatagtaaaggcttaaataaatcttgttatttaactgaagaaaatatctatggctacaaaaaaaaaaaaaaagtactggttactaacctctccaaactattaagtacaaaaatcactttgaaatggtcatgtatgtatctggtttccaaagaaatcttctctaagaaactcaaaggaatttctaagattgtaaagacaaacccagcatactttctagaggtttcatacacttcacatatgtagagttcaattttcacttaaataattattattaatgctgtgattagatatgaaaataaagggcttttgtaac

SEQ ID NO: 9255 - DNA, 429 bp, Homo sapiens
taggaatgttaactccatcttttattatgtcaacctaaagctttatcttggttcagagtgaatatcaaagtatgtgctttggtttttaaactcatggcagagtttctggatgagatgagctagctagcttttctatgcccagacagtgaaggacattgtgtaacccaaaattaactacagatactttcctgctaaatttttcaagcgaatcaagggctttgcctttggttccacatggtaattctggagccgtttggggaaggacattcctggggacagcaaatgcgagggtcctggggcgaggtgtgctcttggccagctcaaggaagagctggtgtggctggagcacagtgagtgagagaaaggggtaggagatgttaggagatggtttgcaggtggctaggcgattgaagttaggaccttcttagg

SEQ ID NO: 9256 - DNA, 327 bp, Homo sapiens
aaaagcaaatgtgcctctttcaaagatgtcaacttggaggttataactaacattacagtctataggtataacctagaataattctagctgcctttcattcgagtctgcctcctttacacagaagaatgtaggaatttaagtgtagttttgggtaacaacagcatgactgaccaagtgggtcgttctaaatgagcgctgatggcatgatacagtgactgacaaatgctgaagggctaaactgctcgtaggatttctcaggcttactgtcttacccacctcttgaatattaagaaacacatttttatgcagagagaaaaatgcagtaaa

SEQ ID NO: 9257 - DNA, 344 bp, Homo sapiens
aatacctaggctgaaggaatatctcttagcctcatggtaaagggaaaagagcaggaaaggtggttgggttaggggatggctcttgagatgtttttctgaaactagcacaggtcacatctgttcacatttaattggccaaagtgggtcatatggccaagcataacattagtgaggtgggaagggtatgcctcctagttgcaggagaactgcacatggcagctggaaagggcagggcgtcactgtgggcatacaaagaaaaaaaaatgcataagtgtgtgtgactatatagtatatatatatgttaattatatatttaaggctaattaaaaattaacagtaaatat

SEQ ID NO: 9258 - DNA, 391 bp, Homo sapiens
tcttagcctcctgagtaactgggactacacgtgcacgccaccatgcccagctaatttttatatttttagtaaagatggtgtttcatgatattggtcaggctggtctcaaactcttgacctcaggtgatccacccacctcagtctcccagtgtgttgtgattacaggtgtgagccaccgcgcccagccattattgtgtaatattttatgggatgactataccacagaaaaattaccatttcattttgttaagtttgctgtcaattcatcagagtaacagataatacttcaataaaccctgttgtataaacatatggattattctccaggatacatacctaaaagaggaattcctgcacagaaggctatggtcatcactaattttgatagact

SEQ ID NO: 9259 - DNA, 355 bp, Homo sapiens
ttagacacacagcagtgccagggaggtctctataataagggaggggaagaggaaggactgcttttcctttcactatttcctagcaactctgtacacaaaacaatgaacggttacaggatgttaggcgggcagtaaaaagctacaggagttaaaaaatagaaaaaaacagacaaatgatttaattcacaaaagcagctccaaaaacccccccaaattatcagcaacctcagatttgatgtacatttaggacctgctttaaagtgtataattttcaacaatataataatgaaatgcgcattttgaagttgcaatctcatttttcatcatttccatttaactacacaatcacacttta

SEQ ID NO: 9260 - DNA, 302 bp, Homo sapiens
gtttgtacagtattcttttggcctcaaacccacctctggtgatgagaatgtttctttccttttggtgcaaggagggcatctcctacatgggagtttcatcacctgcttttaagaagaaagggggaagtcagactggccttcttgcaccgctgttttttaagtgcctttagctcaaaataatgctcctgccaaagtagcatatttttgggtgggatagtctgtcacccttcagtgaacaggtgatttcaataaatatttcccttgtcgaagtcaaataaaatatagagacaaatcttgaaatt

SEQ ID NO: 9261 - DNA, 396 bp, Homo sapiens
ggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgagatttactctcatgtttttgtgtaagagtcttatcgttttggctcttacatttaggtatttgacatattttgcatcaattcttataatcgtgtgagatgtagggggtccaccttcattattttgcacatagatgttcagttgttccagcaccatttaaa

SEQ ID NO: 9262 - DNA, 590 bp, Homo sapiens
gaaaacagtgtggggcaaagaacaggactaggctttgaaacccacagtgggtgttggcaaaagtcacctttgtttcagcttcagtttgaatttaggcacctacttttgatttttattttagagaaaaaatttaaatttatttttaaaagtacatacaataaaatatactcttttgacatacaattctaagaattttcacaagcagaatcatgttactaccaccacaataaaggcacagaacagtttcttcctcagtccgtcccaaaattatctggggtgcgacccctttggagtcaaagcctccctgaatccttaacctctggtaaccatgaatctattctccatcactatagttttgccttttccagaatgctgtaagtggagtcatacaatatttagcctttcagtctggcttctttctcttagcagaatgcatatgagatctctgttgggtttaccagcgcgctgctcatccctttttattgctgagaagtattccatcatgtggatgtactactgtttgtttatccattttccagtggggttgtttctgattatgaataaaggtgctataaacattagtgcacagg

SEQ ID NO: 9263 - DNA, 525 bp, Homo sapiens
ccaaaaggagcaaagaaacaagtcatagatgggcactgcatctttattacagaatagtgcaggagcctcagcccacttacttaagatgagctcccatattgactccttaactctgtgttgcgtgctaaaattataacaaagccatccctggaggagattgtatattatttgaagggcatagccataaatgttttgttttccaggtgatgctgtattcaccatgaaatatctgacttgtagattaacttgcacattattgagaaaccaaaattgttattgagtaaattaaacaatgacaaagttaggtaagagttgttatctatcggtaggatgtcactgcttttctttattttgttttactattttgttcaagataaagttgatagggcagggagcagggagcagtggcccacgcttctaatactagcactttgggaggctgaggtgggaggattgcttgagcccaagagttcaagaccaggctgggcaacaaagtgagaccttgtgtcaattatactttaaaaa

SEQ ID NO: 9264 - DNA, 621 bp, Homo sapiens
gtgcagtggcacgatctcggctcactgcaagctccgccttccgggttcacgccattctcctgcctcagcctcccaaagtgctgggattacaagcgtgagccactgcgcccggcctagttgaggagtaaatggactggattaaagttaaaccataaccccaaattcaggttcttactaaacctcttcaaagaaatggcagcatgatgagctttgaaaatgtgaaagaaaagagcagagaaggagggccccatgcacacacacccgaagaagaattgtgtttcgtggtaacacactaccctcaggttcagaccacactcaacctgtttttccatatattcaaggttcttactcaaccactttcccttctgtggggttgtgatcagaagcctcgtactgttcctacccttggaaacggcgcatgggatacctgccaacaacacatacgcacttcatcatggacagcaaacacactcgtcattcaaaaccagcattcacgggaaagcactgtttctgtttgcctttttatgttaatccgcatgcaacatattttgaaaacagatacacttcaacagttcagaatatgctagtactaataaaaccaacatgttacatgctgaaaaa

SEQ ID NO: 9265 - DNA, 479 bp, Homo sapiens
atgcttacataacaagaacaaaaacacacaaaacaatactaagtattttctactaggacatgtgtatgtgagtgcacagaagaagatggagggattcataagtggattcagtggttctttctgcagatgggagacactgcagtatttcccttttgttaagatgttctcatgtgtttctttttcttggccggtcgcggtggctcacgcctgtaatcccaccactttgggaggccgaggcgggtggattgcctgaggtcaagagttcgagaacagcctggacaacatagtgaaccacccccatctctactaaaaataccaaaagttagctgggcgtggtggcaggcgcctgtaatcccagttacttgggaggctgaggcagatgaatcgcttgaacctgggaggcggaggttgcagtaagctgagatcctgccattgcactccagcctgggcgacagagcgagactccgtctcaaaaaaaa

SEQ ID NO: 9266 - DNA, 370 bp, Homo sapiens
gtctttcctggcccctctaaacaggctctgctctgacctctgccctccccactgatccagggaaactgtcctggccagcatcgggggccttgctgtccttacagggctccatctcccagcctggctgaccactcctttcttcttgaccttcccattgacacccctcaccgccctctgctgtcccctttcctctactaatgcctcttcctccaactctccgcctgtcagtggtccccagaagtcagcctccatccctttctctctttgctttggccagaaaatgatgctcatgcccttgtctttggccctgatctcagtcctgagcccacagcctctatatccagttccctcctcgggaaggccgaggcag

SEQ ID NO: 9267 - DNA, 455 bp, Homo sapiens
ctagtttttttatgtttctgtgcatttctaaatagcaaatgaggtagagaaagctcctatgtggttgacagatctttacctgatgcagtagaccagcgccataaacaaatttgagtctaaataaagggaaaagtatcatttgaaggaggaaaaaaatgggtatttctcagaacactaaagatatatgtcacattgtttccacgcccttggcagctggagaagccctttgttcgtctgagaatagaataatgtattatgtataggtttactcataaaattaacatgttagacatactaagtttaaaggtgccatctattcacacagtgtttacacatttagtaatttaatttactttaaaaaatctttagtgtggtcacgaacacctgaaggaagtcctcagctccttgtctgtgaccatttgggagcaatttgcagaaacctgagcccaccagaa

SEQ ID NO: 9268 - DNA, 911 bp, Homo sapiens
ggaggtggcctggggatggccaccaacaaccttctcttaggactcctgtgtgtggttgctgggcagacccctggcctgaccctgtttgtgcttctctgatctgtagggaggaggctcattgctgctttctgaggtcctgttgtgtcccttccagaaagcatccttagaagagaggacccggtttgatcttctctgaagctcctatcctcttttcttgagggtccccttaaatctgagtggcaagcccacagtggcgagggccagtcgctggaatgtcggggctgctgttgaggtcctcaggctacactggttgtctgtgtcacatggcggtcgggcgtggactttgatccctgttgagagagcatgctgctgtgggcgctgggctggggaaggtccttccatgcttcatgctgccttggaggtttggccaagagggtctctgcccttggcggttgtcagggtcccaggtggaggactactcccagttctttggcttacggaaggtgtctgccatgctttgtgctttgggccgaatcgtctgagcaggctgggccttggaagagttgcgctgcatgagcttggggcctcccagcagctgcagcctgtgtagaaggtggtccaggcttagggaacaggagtgaacagacttcagccccacctggcaggggctggctcccgaggttgggcccagtccctgagggtctgctctgctacgggtctgcccttgagtggccttccgtggagggtgtgtgaccaggtggatggcgcagggcctctggagccctctcctcaggagcagtcctcagcctttttctgtaaaagacttttctttggtgttctaggtggtcagcaggttccaggctggtgtttacaatctcggaggaagtgcgatggtttctgttcttttgaca

SEQ ID NO: 9269 - DNA, 3799 bp, Homo sapiens
ctccggcttccaccccgccccctgcgctcacctgcccgcgcgctcgccttccggggacccggggcccatggacacatacacccagccctgctgtcccgcgcgccagctcaccagccctacccaagggacatcattcacgcctgggcgcctccgccgggctccgggagcccaaggtcgcggctgggccagcgctgagcgtcagaggacgagagcaggggcctccccggtcgccccagcaggcccaggcacataggtgcccagagatccctggcttctgatcgcccggaagactaagagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgctttgcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactcatccacaggccgcacagctttaatggaagcgtcaagagaaggggtagtggaaatagttcgaggcatattggaaagaggaggtgaagtgaatgcatttgacaacgacaggcatcacgctgctcattttgctgctaaaggaggctttttcgatatattgaagcttctttttgcctacaatggagacgtggggctgatttcgataaatgggaacacaccacttcattatgctgccatgggtggttttgcagactgctgtaaatatatagctcagcgaggatgtgacctgaaatggaagaatttagatcataaaacgcccagggctgtggctaaggaaggcggcttcaaagcagcaagcaaagaaatacgccgagcagagagaatcgctaataaactagccaggccaggagccaaaaatccaaatccactgtgggcccttagactgcacgattggtccgtagaacgtgaggctttcctccgggaagcctttgcggttttagacaggggtgatggaagcatcagcaagaacgacttcgtgatggtgttggaggaaaggcaggattatgcaagctcagaacagctggctgccatcgctcaccttcatgagaaaacccggggaggaggggtcaatattaatgaattctttaaaggaaccagatatttaaacaagtcttttgtcttaggatcgtatggacctaagaaaaaggaaaaagggatgggcaaaaaaggaaagaaagggaaatttgtcttaccccttccaatctgtgtcattcctgagtacgcgtttccacgccggcaggatggtgggccaccgtattacatgattgagacctacaagaatgtcactgatagcagccggtttaatagagatcatcccccagaacatcccattcaggatgactctgtttggtacattgatgattcagagaaggtattttcaaacattaatattatcaccaaagcaggggatctggcttctctgaaaaaggcctttgaatcaggaatacctgtggatatgaaggataattattacaaaactccgctaatgacggcgtgtgcaagtggaaacatagatgtggtcaagtttcttcttgaaaaaggagctaacgttaatgcaacagataactttctgtggactccacttcattttgcatgccatgcaggccaacaagacattgttgagcttcttgttgaatctggagctttaatagatgcagcttcaatcaacaactcaactcctttaaatagagccattgaaagctgcagactggatacagtaaaatacctacttgatattggtgctaaattccagctggaaaatagaaaagggcatagtgccatggacgttgcaaaggcatatgctgattatagaataattgatctgattaaagaaaagctagataacttgccgaaaccagcagaaaatcaaaaactaaaaggcaagacacctcctatactgaagactgaaggccctgaaattaagaaagaagaggaactgctgtcatcaatttatggtgtaccaaccacatcagagggaaagaaagtacagaagggtaatgtggttcatctgaattcattgattaccagtggttatactaagaaagtggatatcacatttattccacggaggatttggagtcctgaagccacaacagcagagctgatcaggaagagggaactacggcgagagaggtttacacatgaggtggacttcgacgattttatgatgccttttcagaagaacatcacagagaaagctcgagcactggaagctgccttgaagacctaagtcatagcagttatttcttggggtaaatgctttgaggcccagggaccaatctttggagaaagtagatatttccatcaaagccaaagcaatccatacaccaagaacttgttaccaagaatttctttttgctttaacaactataaatattcttagctgtctagagaaaagatgtatgttattttgaaatgaatggtatgtcattctggataaatccccaagcccctttatgaatgtagtgaaatacatggcatgtgggttataaacgttgctgtcaaaagatttaccaggtctacaccattatgcttattatttttttaattatcctttttatttattaaatagagacagagtctcactatattgccccagctggtctcgaactcttgagctcaggcagtcctcccaacttggccgtcgaaagtgctgggattataggcatgagctactgtgcccagcctgcttattgaagatacatttctagtggaaattgatgaaacaatttaggttttggaaaaagaagtaatatttaatcttttaaggaaggagtttatttctcacatgccattataaactatgtgtattagataccttgggttgaatacacttttaacagccctagatcgatagccctagccctagatagatagccctagccctagatagatagctattaggttggtgcaaaagtaattgtggtttttgccataacctttaattgcagcaaaaactgcaattacttttgctccaacctgacagctaggtatctagctagctagaaaggcagatagacagatatatagatgatagatagatagatagatgatagatagatagatgatagatagatagatagatagatagatagatagatagatagatagatagatagagatttattgcaaataattggtttacataattttgggccccagatggttaagtgctaaatttgtagggtaggctatcaggaagtgcaggctggaaacatgcaggagctgtccctgaagtccacaagtggaatttcttcttcatcatggaaacctcagttttgttcatacacctaaatacttcagtatgtctttcctaaaataaaaggcatccatttacctaaccagattacgattgtg

SEQ ID NO: 9270 - DNA, 3845 bp, Homo sapiens
ctccggcttccaccccgccccctgcgctcacctgcccgcgcgctcgccttccggggacccggggcccatggacacatacacccagccctgctgtcccgcgcgccagctcaccagccctacccaagggacatcattcacgcctgggcgcctccgccgggctccgggagcccaaggtcgcggctgggccagcgctgagcgtcagaggacgagagcaggggcctccccggtcgccccagcaggcccaggcacataggtgcccagagatccctggcttctgatcgcccggaagactaagagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgctttgcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggcatgtgtactcagtcctcaatgccgtatgccagttctatgataaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactcatccacaggccgcacagctttaatggaagcgtcaagagaaggggtagtggaaatagttcgaggcatattggaaagaggaggtgaagtgaatgcatttgacaacgacaggcatcacgctgctcattttgctgctaaaggaggctttttcgatatattgaagcttctttttgcctacaatggagacgtggggctgatttcgataaatgggaacacaccacttcattatgctgccatgggtggttttgcagactgctgtaaatatatagctcagcgaggatgtgacctgaaatggaagaatttagatcataaaacgcccagggctgtggctaaggaaggcggcttcaaagcagcaagcaaagaaatacgccgagcagagagaatcgctaataaactagccaggccaggagccaaaaatccaaatccactgtgggcccttagactgcacgattggtccgtagaacgtgaggctttcctccgggaagcctttgcggttttagacaggggtgatggaagcatcagcaagaacgacttcgtgatggtgttggaggaaaggcaggattatgcaagctcagaacagctggctgccatcgctcaccttcatgagaaaacccggggaggaggggtcaatattaatgaattctttaaaggaaccagatatttaaacaagtcttttgtcttaggatcgtatggacctaagaaaaaggaaaaagggatgggcaaaaaaggaaagaaagggaaatttgtcttaccccttccaatctgtgtcattcctgagtacgcgtttccacgccggcaggatggtgggccaccgtattacatgattgagacctacaagaatgtcactgatagcagccggtttaatagagatcatcccccagaacatcccattcaggatgactctgtttggtacattgatgattcagagaaggtattttcaaacattaatattatcaccaaagcaggggatctggcttctctgaaaaaggcctttgaatcaggaatacctgtggatatgaaggataattattacaaaactccgctaatgacggcgtgtgcaagtggaaacatagatgtggtcaagtttcttcttgaaaaaggagctaacgttaatgcaacagataactttctgtggactccacttcattttgcatgccatgcaggccaacaagacattgttgagcttcttgttgaatctggagctttaatagatgcagcttcaatcaacaactcaactcctttaaatagagccattgaaagctgcagactggatacagtaaaatacctacttgatattggtgctaaattccagctggaaaatagaaaagggcatagtgccatggacgttgcaaaggcatatgctgattatagaataattgatctgattaaagaaaagctagataacttgccgaaaccagcagaaaatcaaaaactaaaaggcaagacacctcctatactgaagactgaaggccctgaaattaagaaagaagaggaactgctgtcatcaatttatggtgtaccaaccacatcagagggaaagaaagtacagaagggtaatgtggttcatctgaattcattgattaccagtggttatactaagaaagtggatatcacatttattccacggaggatttggagtcctgaagccacaacagcagagctgatcaggaagagggaactacggcgagagaggtttacacatgaggtggacttcgacgattttatgatgccttttcagaagaacatcacagagaaagctcgagcactggaagctgccttgaagacctaagtcatagcagttatttcttggggtaaatgctttgaggcccagggaccaatctttggagaaagtagatatttccatcaaagccaaagcaatccatacaccaagaacttgttaccaagaatttctttttgctttaacaactataaatattcttagctgtctagagaaaagatgtatgttattttgaaatgaatggtatgtcattctggataaatccccaagcccctttatgaatgtagtgaaatacatggcatgtgggttataaacgttgctgtcaaaagatttaccaggtctacaccattatgcttattatttttttaattatcctttttatttattaaatagagacagagtctcactatattgccccagctggtctcgaactcttgagctcaggcagtcctcccaacttggccgtcgaaagtgctgggattataggcatgagctactgtgcccagcctgcttattgaagatacatttctagtggaaattgatgaaacaatttaggttttggaaaaagaagtaatatttaatcttttaaggaaggagtttatttctcacatgccattataaactatgtgtattagataccttgggttgaatacacttttaacagccctagatcgatagccctagccctagatagatagccctagccctagatagatagctattaggttggtgcaaaagtaattgtggtttttgccataacctttaattgcagcaaaaactgcaattacttttgctccaacctgacagctaggtatctagctagctagaaaggcagatagacagatatatagatgatagatagatagatagatgatagatagatagatgatagatagatagatagatagatagatagatagatagatagatagatagatagagatttattgcaaataattggtttacataattttgggccccagatggttaagtgctaaatttgtagggtaggctatcaggaagtgcaggctggaaacatgcaggagctgtccctgaagtccacaagtggaatttcttcttcatcatggaaacctcagttttgttcatacacctaaatacttcagtatgtctttcctaaaataaaaggcatccatttacctaaccagattacgattgtg

SEQ ID NO: 9271 - DNA, 1226 bp, Homo sapiens
ctccggcttccaccccgccccctgcgctcacctgcccgcgcgctcgccttccggggacccggggcccatggacacatacacccagccctgctgtcccgcgcgccagctcaccagccctacccaagggacatcattcacgcctgggcgcctccgccgggctccgggagcccaaggtcgcggctgggccagcgctgagcgtcagaggacgagagcaggggcctccccggtcgccccagcaggcccaggcacataggtgcccagagatccctggcttctgatcgcccggaagactaagagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgctttgcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactcatccacaggccgcacagctttaatggaagcgtcaagagaaggggtagtggaaatagttcgaggcatattggaaagaggaggtgaagtgaatgcatttgacaacgacaggcatcacgctgctcattttgctgctaaaggaggctttttcgatatattgaagcttctttttgcctacaatggagacgtggggctgatttcgataaatgggaacacaccacttcattatgctgccatgggtggttttgcagactgctgtaaatatatagctcagcgaggatgtgacctggaatggaagaatttagatcatatacgccgagcagagagaatcgcttctagccgg

SEQ ID NO: 9272 - DNA, 401 bp, Homo sapiens
catgaattgtcaatggaaatattagcaaaggcaaaggctgatatgactatagttgataatgaaggaaaaggtaaaaatcccgacatcctctccagcagattgcaattcattttgtagccagaaagcaataacatggactctttttgttttccaactttagaagtgaattacttatggttttaagggaaaggctaaattctcactcctatacctaaacctactgtctcctcatactttgaaaatgagatagctatatcttagggaaatcatttatgagagcttgctcatatacttagattaatttgtgtttggtggtttcttttaaatgaggagaattttgaacattatacacactgattattcattataaattataaactcttctttaaaacaaagatgaa

SEQ ID NO: 9273 - DNA, 3863 bp, Homo sapiens
ctccggcttccaccccgccccctgcgctcacctgcccgcgcgctcgccttccggggacccggggcccatggacacatacacccagccctgctgtcccgcgcgccagctcaccagccctacccaagggacatcattcacgcctgggcgcctccgccgggctccgggagcccaaggtcgcggctgggccagcgctgagcgtcagaggacgagagcaggggcctccccggtcgccccagcaggcccaggcacataggtgcccagagatccctggcttctgatcgcccggaagactaagagtcccatgaagtgggcaccattgctattgccagttcacagatgcagaaactgaggtaaaaactagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgctttgcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactcatccacaggccgcacagctttaatggaagcgtcaagagaaggggtagtggaaatagttcgaggcatattggaaagaggaggtgaagtgaatgcatttgacaacgacaggcatcacgctgctcattttgctgctaaaggaggctttttcgatatattgaagcttctttttgcctacaatggagacgtggggctgatttcgataaatgggaacacaccacttcattatgctgccatgggtggttttgcagactgctgtaaatatatagctcagcgaggatgtgacctgaaatggaagaatttagatcataaaacgcccagggctgtggctaaggaaggcggcttcaaagcagcaagcaaagaaatacgccgagcagagagaatcgctaataaactagccaggccaggagccaaaaatccaaatccactgtgggcccttagactgcacgattggtccgtagaacgtgaggctttcctccgggaagcctttgcggttttagacaggggtgatggaagcatcagcaagaacgacttcgtgatggtgttggaggaaaggcaggattatgcaagctcagaacagctggctgccatcgctcaccttcatgagaaaacccggggaggaggggtcaatattaatgaattctttaaaggaaccagatatttaaacaagtcttttgtcttaggatcgtatggacctaagaaaaaggaaaaagggatgggcaaaaaaggaaagaaagggaaatttgtcttaccccttccaatctgtgtcattcctgagtacgcgtttccacgccggcaggatggtgggccaccgtattacatgattgagacctacaagaatgtcactgatagcagccggtttaatagagatcatcccccagaacatcccattcaggatgactctgtttggtacattgatgattcagagaaggtattttcaaacattaatattatcaccaaagcaggggatctggcttctctgaaaaaggcctttgaatcaggaatacctgtggatatgaaggataattattacaaaactccgctaatgacggcgtgtgcaagtggaaacatagatgtggtcaagtttcttcttgaaaaaggagctaacgttaatgcaacagataactttctgtggactccacttcattttgcatgccatgcaggccaacaagacattgttgagcttcttgttgaatctggagctttaatagatgcagcttcaatcaacaactcaactcctttaaatagagccattgaaagctgcagactggatacagtaaaatacctacttgatattggtgctaaattccagctggaaaatagaaaagggcatagtgccatggacgttgcaaaggcatatgctgattatagaataattgatctgattaaagaaaagctagataacttgccgaaaccagcagaaaatcaaaaactaaaaggcaagacacctcctatactgaagactgaaggccctgaaattaagaaagaagaggaactgctgtcatcaatttatggtgtaccaaccacatcagagggaaagaaagtacagaagggtaatgtggttcatctgaattcattgattaccagtggttatactaagaaagtggatatcacatttattccacggaggatttggagtcctgaagccacaacagcagagctgatcaggaagagggaactacggcgagagaggtttacacatgaggtggacttcgacgattttatgatgccttttcagaagaacatcacagagaaagctcgagcactggaagctgccttgaagacctaagtcatagcagttatttcttggggtaaatgctttgaggcccagggaccaatctttggagaaagtagatatttccatcaaagccaaagcaatccatacaccaagaacttgttaccaagaatttctttttgctttaacaactataaatattcttagctgtctagagaaaagatgtatgttattttgaaatgaatggtatgtcattctggataaatccccaagcccctttatgaatgtagtgaaatacatggcatgtgggttataaacgttgctgtcaaaagatttaccaggtctacaccattatgcttattatttttttaattatcctttttatttattaaatagagacagagtctcactatattgccccagctggtctcgaactcttgagctcaggcagtcctcccaacttggccgtcgaaagtgctgggattataggcatgagctactgtgcccagcctgcttattgaagatacatttctagtggaaattgatgaaacaatttaggttttggaaaaagaagtaatatttaatcttttaaggaaggagtttatttctcacatgccattataaactatgtgtattagataccttgggttgaatacacttttaacagccctagatcgatagccctagccctagatagatagccctagccctagatagatagctattaggttggtgcaaaagtaattgtggtttttgccataacctttaattgcagcaaaaactgcaattacttttgctccaacctgacagctaggtatctagctagctagaaaggcagatagacagatatatagatgatagatagatagatagatgatagatagatagatgatagatagatagatagatagatagatagatagatagatagatagatagatagagatttattgcaaataattggtttacataattttgggccccagatggttaagtgctaaatttgtagggtaggctatcaggaagtgcaggctggaaacatgcaggagctgtccctgaagtccacaagtggaatttcttcttcatcatggaaacctcagttttgttcatacacctaaatacttcagtatgtctttcctaaaataaaaggcatccatttacctaaccagattacgattgtg

SEQ ID NO: 9274 - DNA, 1545 bp, Homo sapiens
ctccggcttccaccccgccccctgcgctcacctgcccgcgcgctcgccttccggggacccggggcccatggacacatacacccagccctgctgtcccgcgcgccagctcaccagccctacccaagggacatcattcacgcctgggcgcctccgccgggctccgggagcccaaggtcgcggctgggccagcgctgagcgtcagaggacgagagcaggggcctccccggtcgccccagcaggcccaggcacataggtgcccagagatccctggcttctgatcgcccggaagactaagagctttagttttggtccagaaagcattttcaaggagctggtcaagcatggctttagcagataagagacttgagaacttacagatctacaaagttcttcaatgtgtgcggaacaaagacaagaagcagatagagaagctgaccaagcttggataccctgaactaatcaattatacagaacccattaatggacttagtgctttgcacttagcctcagtttccaatgatattgatatggtcagctttctccttgaccttggtgctcaccctgatgtgcaagaccgaatgggctgtactcccacaatgagggctgcagaactgggccatgaattgtcaatggaaatattagcaaaggcaaaggctgatatgactatagttgataatgaaggaaaaggtgttttgttttactgcattttaccgactaagcggcattatcgctgtgctctgatcgcccttgaacatggtgcagatgtcaacaattctacctatgaaggaaagccaatattccttagagcttgtgaagatgcacatgatgttaaagatgtgtgcctgacatttttggaaaaaggagccaatcctaatgcaatcaactcatccacaggccgcacagctttaatggaagcgtcaagagaaggggtagtggaaatagttcgaggcatattggaaagaggaggtgaagtgaatgcatttgacaacgacaggcatcacgctgctcattttgctgctaaaggaggctttttcgatgtaataatctattctttgctttaaaatttgttgctaaaacttttctgtcctttttctcaaatttttttatatgtcatatagagtacgctaaggcagacatttttctgagttacctatgttgttttcatcttgatttccccaaataattctaaaattatatttttaaaaacttcatctctttatttagttttatgtgtttgctaatttacttatttaatattattcatagtatttttctgtacactcgatgataacaatttaaaacttctgccacctgggactactgtattttatgacttcattacatactagagtcttcaaaatataatatgatctaattatgggagaacaatgccctcatactcttatctccatggtgtttgtgtgtattagataatgatatacctgaattttaaactcaagtattctgattatctaaacatacagcaaagaatatctcactgatacagtaacattgcagaaacaaaataaaaacactattttttta

SEQ ID NO: 9275 - DNA, 219 bp, Homo sapiens
ttttaagtatataaaagatcaaatttctattcaattacagtaggtcagaagtgacagcttagataaaaagttagcatggcagtacctgagtcatattcctagttatttattatcttcaaggctcagtacaaacaaggaaaagccattatttttcttgcaggcaaaagaggcagttaaaagtttgtttatttaacttaggttgggagttgctcttgcctt

SEQ ID NO: 9276 - DNA, 549 bp, Homo sapiens
taggctcactgctaccttttacagagttcacgggattttacgtaactaacccgcagtgtggatttaccaaaagatcacagcactagcggagacttccagaaactgtctcatgctttctgacctccagggaaagttgtacccacgacatcctcaaccactggtaccatggaagacctgtccctgcccatttctcaaaaatgcacagctcttccctgcctggagcacatgaagtcccatctccctgtccccagacctttaggctctgttgaagttctggcattgcttatgagacccttcctgtccaaggaaggtctaagtcaactcctccattggactggagatgaggctcactggtgacatcctgtgtcgactcagtaataaatagtcacttgggaggcgatgtttatgcaggtgtggatgttgagttttactatgggaatcattccagcctgacaaaatgtgttttaaggaataggtagataactgggacttcctctgttattctaacaagtcgaagcttcctaattaaactgtccatggatctcactt

SEQ ID NO: 9277 - DNA, 448 bp, Homo sapiens
aattagatcacgataatggttgcacaactctgtgaatatattaaaaaccattgacttaccccataaatatatacacctaccatgtacccataaatattaaaaatcaaaacaaaacattgacttatacacttcaaatgggtgaattgtgtgttatatgaattttttttttttttttgaaatggagtctcactctgtcacccaggctggagtgcagtggcctgatcttagctcactgcaacctccacctcccgggttcaactgattctcctacctcagcctcctgagtagctgggattctgcagcctggatgacagaatgagactgtctcaaaaaataaaaaaataataataaattttttaaaagttgcttttatctgatagagaagcttgagatttttatgattagaatgattaaaaataaaactgagaaagcaagacaactaaccttt

SEQ ID NO: 9278 - DNA, 788 bp, Homo sapiens
aaaacaagggcagtcaacgtgtaaagcagccagtggaccggctcccaggataatctgaatcccaggcttgtttacgcctgtttcacagacaccattgagggctcactggccctccctgggcctctgttcccctaatgtaaaataaatacattgaagcaaacagcagtcttcaaactttcccttttggcaaggaaaacatgatctctccatgcaaaaggttgacagaagacaatatcagagctgcttttctggagaggtgaggggatggaggccctgaaggccctgcagcagcacgcgggggtcctctagggctccccaaaatctccagagcagtgcagtcagagagccatctgcaatcacagccacatttgttttctgtactgtctactagggtagccacgtttagcacttgaaatgtggtgcaggtgacagagaaacattatgattttctttagttttggccattgcattggaggacactgctttatagcaggtcaaaagcttctgactcagtggatgggctaccagcatttgtcaaatacttttgaggaatgagacacagctcagctgacatactcccttcaaaagtccccaaggataccatgggccctgctttagacggggaggaatcccaggctgtgactgctccaatgactcatccggggttgcatggtttgtacttggtggaagctgagagtagccccagctctggctgcctccaaagccctgtgcctttaatggctttgctttgcttcctgctgctctaaggtccccatcactctgcccac

SEQ ID NO: 9279 - DNA, 556 bp, Homo sapiens
ccaattgtggacaagataaggaccattgcccaggctgtctatggagccaaagatatcgaactctgtcctgaggcacaagtcaaaatagatcgttacactcagcagggttttggaaatttgcccatctgcatggcaaagaccgatctttctctgtctcaccaacctgacaaaaaaggtgtgccaagggacttcatcttacctatcagtgatgtccgggccagcataggtgctgggttcatttaccctttggtcggaacgggaagcagagaatctcccctctggctctagttggagaatcccaacccaagcaagtccatctttgaacaataaacatctccagtactgctggctttggaagaccccatggtgagatgctggagcttttttccactcctgatttcactttctaaatatttacttttactttccatgttcacttgtaggccagattttttttttcctaccattgaattatttcatcatgttctatttaattattgttttaattggcattggtgaccacaaataataataaatactattaactgatgtaaca

SEQ ID NO: 9280 - DNA, 508 bp, Homo sapiens
ccaattgtggacaagataaggaccattgcccaggctgtctatggagccaaagatatcgaactctgtcctgaggcacaagtcaaaatagatcgttacactcagcagggttttggaaatttgcccatctgcatggcaaagaccgatctttctctgtctcaccaacctgacaaaaaaggtgtgccaagggacttcatcttacctatcagtgatgtccgggccagcataggtgctgggttcatttaccctttggtcggaacgtctcgctctgttgcccaggctaaagtgcagtggcatgatctcggctcactgcaacctccacctcccgggttcacaccattctcctgcctcagcctcccaagtagcagggactacaggcacccgccaccacacctggctaactttttgtatttttagtggagacagagatgacccaaattcttaactgcctcataaatactgttaatatattgaaagttttgccctaggcttttattaaagtcaactatat

SEQ ID NO: 9281 - DNA, 2344 bp, Homo sapiens
cagtgacctgctaaaaagtcaactagctcagagttttgctggcctttatgtgagaaatccaagaaagtgttcacttttttgggatgcgagactccttggtctcatttgccttcactttgcatttgttagtgacctccactaacccccacttccatgcatattgacgagggatctagtctaagtaagaatgtcttttgcctgcgcgtggaggcacagtagaaatctcaaggctttacccagaagagcccagtcagggagaggtgtaaatgcaaaattgccaaatagcacaaacaatgaatgttttctggttgttatatagatgccaaaatagcactttgatatttgcaaagtgctttatgctttttaataattgttagctgtttctcacatcattgtgagttagatcagtattatgaccgctgtcttagggaaggcctgggaacaggagtgtgcaggctgtcctgaagagaggctgaggacagtgtgaataattgtagcctgaccttttgcattctccagctcagctgctaggaagacttacttgtcatgatttatataataaaattaaggacactgaaaattcttatgcttgatgaaaaacttaaggctagcctagaagggccaaacatgtccttattgacaaagctggtctttgtcgcctaattagggtatcctagctatgttccatttctagtaaggggctgtagttagatgactcttgtatagatttcagttacttatgctgaagatccctgtgctaggttagcctttagaagttagagttgtggaaagcagtattgttttcttctctagtgattgttaccctacacatttcatggaagcatcttcacaaaatatcagacacagtggaagggggaaaaaaagctacgagattgtttttacacttttagcaaagtttctgtggatgctagtaatttatacttgatcagttgtattctagtaaagaacctctttggggactgtaggaaagcatgtttttgtggttataaaaacacttaaaaatcctgataattctgggcttgtataatgcctgttgatcttgccctcttaatcagtttattgttattcacaaatgcaaataggttttcaaactacagacagttttgaaagacattaattctcattttcttctagtcaggagtaatacaagcaaacaagtgtccgttttgaattctgatttgtaatctgaatactaaacatattagacccacctgaaaataatatagccaatttctaggtaatcttactgctttgtgggtttctttccatgtacatctacctcttccagctgttttaagttttctcaagtctgtgcctatgaaatctcatccaacttttgattattcatggattgattatccgctttttttttgcttttttgctgccattgctatgcctggtctcgtctgcatcaaatatactacatatcagcaactttagagaatgggttcaacagggagtggagagtgaagctaatgtaaaatagtttagtggcagtgggaatctttggacttcatttacctctctcattatttctattaccatggataaaaaagtcagctgctacgttgatatcccttctatgagcacattcttagcagaagaaaacaatccaactaccaacacccgactctattggtgcatttaaaatgtgattccattttttcttacaattcttcagggaacttacctgcattaagtgaggttaaatgcattcaggaggttgtttgtttcttctatctagttttagaataatatttcttcggcaaaccctgctaactgcggttcacccttgaaaacgttaatctgaggactttttccaccaactcattaatgatggtggaagcaagtgtattatttgtttcctggagaatttgatgaagagcagtcttcctctgctgccctttactaagcaaaacctggagcaatttaaataggctaaatggttttgattaaatcttgagctccgagttggaaggagaaaatgagaagttaaccccttgagccatgtggtctctttacaatcaagagactgtacatatgtgaaaaaatacaaattaaggacctgtgttcatagacaatctaaactgtgtttctgaagtttgtgcacatttttcttcactgtaatgttattttacagctgtttgttaaaatagtgaataatttaatgatcctaaaagtaacaggtttcgtgtgagtgtgcttgtatacgtgagatttgccttattttcaggttgttttatttaacgatggttccttggacagcattctggtgttcagcaaccaatatggaatatttgtcattaaatccatatcagtcttt

SEQ ID NO: 9282 - DNA, 433 bp, Homo sapiens
aaatgagaagttaaccccttccaactcggagctcaagatttaatcaaaaccatttagcctatttaaatcttgagctccgagttggaaggagaaaatgagaagttaaccccttgagccatgtggtctctttacaatcaagagactgtacatatgtgaaaaaatacaaattaaggacctgtgttcatagacaatctaaactgtgtttctgaagtttgtgcacatttttcttcactgtaatgttattttacagctgtttgttaaaatagtgaataatttaatgatcctaaaagtaacaggtttcgtgtgagtgtgcttgtatacgtgagatttgccttattttcaggttgttttatttaacgatggttccttggacagcattctggtgttcagcaaccaatatggaatatttgtcattaaatccatatcagtcttt

SEQ ID NO: 9283 - DNA, 316 bp, Homo sapiens
aattaaggacctgtgttcatagacaatctaaactgtgtttctgaagtttgtgcacatttttcttcactgtaatgttattttacagctgtttgttaaaatagtgaataatttaatgatcctaaaagtaacaggtttcgtgtgagtgtgcttgtatacgtgagatttgccttattttcaggttgttttatttaacgatggttccttggacagcattctggtgttcagcaaccaatatggaatatttgtcattaaatccatatcagtcttttaccatgtcattcttctttgccacacattaaatgtcactcagctctat

SEQ ID NO: 9284 - DNA, 3807 bp, Homo sapiens
cagtgacctgctaaaaagtcaactagctcagagttttgctggcctttatgtgagaaatccaagaaagtgttcacttttttgggatgcgagactccttggtctcatttgccttcactttgcatttgttagtgacctccactaacccccacttccatgcatattgacgagggatctagtctaagtaagaatgtcttttgcctgcgcgtggaggcacagtagaaatctcaaggctttacccagaagagcccagtcagggagaggtgtaaatgcaaaattgccaaatagcacaaacaatgaatgttttctggttgttatatagatgccaaaatagcactttgatatttgcaaagtgctttatgctttttaataattgttagctgtttctcacatcattgtgagttagatcagtattatgaccgctgtcttagggaaggcctgggaacaggagtgtgcaggctgtcctgaagagaggctgaggacagtgtgaataattgtagcctgaccttttgcattctccagctcagctgctaggaagacttacttgtcatgatttatataataaaattaaggacactgaaaattcttatgcttgatgaaaaacttaaggctagcctagaagggccaaacatgtccttattgacaaagctggtctttgtcgcctaattagggtatcctagctatgttccatttctagtaaggggctgtagttagatgactcttgtatagatttcagttacttatgctgaagatccctgtgctaggttagcctttagaagttagagttgtggaaagcagtattgttttcttctctagtgattgttaccctacacatttcatggaagcatcttcacaaaatatcagacacagtggaagggggaaaaaaagctacgagattgtttttacacttttagcaaagtttctgtggatgctagtaatttatacttgatcagttgtattctagtaaagaacctctttggggactgtaggaaagcatgtttttgtggttataaaaacacttaaaaatcctgataattctgggcttgtataatgcctgttgatcttgccctcttaatcagtttattgttattcacaaatgcaaataggttttcaaactacagacagttttgaaagacattaattctcattttcttctagtcaggagtaatacaagcaaacaagtgtccgttttgaattctgatttgtaatctgaatactaaacatattagacccacctgaaaataatatagccaatttctaggtaatcttactgctttgtgggtttctttccatgtacatctacctcttccagctgttttaagttttctcaagtctgtgcctatgaaatctcatccaacttttgattattcatggattgattatccgctttttttttgcttttttgctgccattgctatgcctggtctcgtctgcatcaaatatactacatatcagcaactttagagaatgggttcaacagggagtggagagtgaagctaatgtaaaatagtttagtggcagtgggaatctttggacttcatttacctctctcattatttctattaccatggataaaaaagtcagctgctacgttgatatcccttctatgagcacattcttagcagaagaaaacaatccaactaccaacacccgactctattggtgcatttaaaatgtgattccattttttcttacaattcttcagggaacttacctgcattaagtgaggttaaatgcattcaggaggttgtttgtttcttctatctagttttagaataatatttcttcggcaaaccctgctaactgcggttcacccttgaaaacgttaatctgaggactttttccaccaactcattaatgatggtggaagcaagtgtattatttgtttcctggagaatttgatgaagagcagtcttcctctgctgccctttactaagcaaaacctggagcaatttaaataggctaaatggttttgattaaatcttgagctccgagttggaaggagaaaatgagaagttaaccccttgagccatgtggtctctttacaatcaagagactgtacatatgtgaaaaaatacaaattaaggacctgtgttcatagacaatctaaactgtgtttctgaagtttgtgcacatttttcttcactgtaatgttattttacagctgtttgttaaaatagtgaataatttaatgatcctaaaagtaacaggtttcgtgtgagtgtgcttgtatacgtgagatttgccttattttcaggttgttttatttaacgatggttccttggacagcattctggtgttcagcaaccaatatggaatatttgtcattaaatccatatcagtctttaaaaaaaaaaaaaaaaaaaaaaaaaactcgaacagtctctctctctctctccagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgag

SEQ ID NO: 9285 - DNA, 601 bp, Homo sapiens
aacttccaaatggatccctccctgcaagtgtggagctggcgctaccaggcactgctctggccatgcgtctaagacacaggcagagggcgctgcccaccacgctggcgacggcctcaaagcccctgttcatgcctgggacagcgcccaaggaccttgctcatgcctgggacaggccccagggcccccactggctgcagtcagcagcgggcagggtggtgggggaaggtatggacactccgtgggccggagctgggagaacaaggcctattattggacacctggtggccatggcaaccacacaaggatgcctgagactgaaaatctgtgggcttcaaggagctccagctcttgcactggctgagtcacagtgactatataactcttactcccacttttgggacactttttgagagggacagggatcctatctaactacacgggatagacatcgcccaagaccgtcctgagcaagcctggacgctgtgaccctaacgatgaaggtgtcccgcagacaatgtccggggcaggcaccatgctctcccaacctaccacagccagatgtttttgtaaagaacaataaaaatgaattactagaaaagca

SEQ ID NO: 9286 - DNA, 308 bp, Homo sapiens
ggagttcaagaccagcttgggcaacatagagagaccccatctctacaaaaaggaaaaaaatagccatgtgtggtggcaggtgcctgtagtcccagctacttgggaggctgcaatgcgacaggaggattgcttgtgcccaggaggtccaggctgcagtgagctgtgatcgcagcactgcactccagcctcgatgacagagtgagaccctgtctcaaaaacgaaccaaaaaaacattttgagatctcacacccttgtcattttcctaaaacaactgtttcttttttgagcagcttccagatttacatacc

SEQ ID NO: 9287 - DNA, 448 bp, Homo sapiens
ctggaagaattgctcagtctcttgattttagatttaatacttgtaaaaccctataatgactggcactagtcagacaagtgcttgttcttttgacagcatttattaagcacttactatgtgtaaggcactatgcctaatgctggggcacagcaattacagggcacacaagacaagtttatgccctagctggagacatagccactaatcaaataaagaggtatttcgttatctctatgtatatttaagactcagcccaagagctcacccacctagtgtttggcaggtagggggtggttaatttgactcacaaagttccctagtgtcaaggttgaacttgccctttgggagttcagcatgacaaatatgacttgcgaagatatagaggcagacttctttctggtggctcttaagagacccctgtcttgaaagaactgccactctgtagcag

SEQ ID NO: 9288 - DNA, 520 bp, Homo sapiens
gtttattcccccaagatgacaacttaagtctttgagtctatcagttccaggcaagggtcaagctccacaggaccagccatcagggaaataacatgacttgttatttccagactacgttcagaacagctggtcatgctccctctctcggacaatagaacttgaatgagtctaaagaggcccagagcttcaaaacaaaaagtttacctgtaggagtgaaggagtttattcatttccagtctctaatctagaaggccttttcctcccatgaaggatcttcattctgaaggttggtatgtaaattcagccagagtagtcggtgtgaacttgaaacctaggaaacttccatctccttatagtttttaaccctttgaggataagttttgtaactatattttccaaatgtaacaccattgtctgctgacaatctgttctacattaatacgccatttttttcttccacattcttctccaacacaattttactactccagaaaacttttgcccataaatttaaaaatcc

SEQ ID NO: 9289 - DNA, 432 bp, Homo sapiens
gattcccacccaaagtaactactttgaattctggagagaaggcaagggtttaagaagtggggagtaggagcttgagctgggaggcgcgcagggatcgtgctgagtacaatgtgtgtcttgttccggcggctgtcctgggcctccgtccacctggagtgcgggctggtgtcatctcaacaagtggccagatttgactgctcaccttgaggtaagctctgggattttgcagctgggtttccacgcttggtctgtctcaagattagtccctagaacttcgaagtaagcacgtaattagagactagctcacagacacatgtgaagagagtatacggtgagaaaggggaggggtatggagtctattttaagattaagggaaaaggcttctgcagtttgctctaaggttgcatctcaggactaaagagaaaggaaaaa

SEQ ID NO: 9290 - DNA, 1101 bp, Homo sapiens
aagctaaacgcgcggcttgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgat

SEQ ID NO: 9291 - DNA, 1011 bp, Homo sapiens
aagctaaacgcgcggcttgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgat

SEQ ID NO: 9292 - DNA, 3397 bp, Homo sapiens
aaaatgtttcttacatgtgccagccaggctacacgatggaattgaatggctccagaatcaggacttgtacaattaatggcacatggagtggagtaatgccaacttgtagagctgttacctgcccaactcctccccagatctctaatggaaggctggaaggaacaaatttcgactggggctttagtattagctacatctgttctccaggctatgagctatccttccctgctgttttgacctgtgtagggaatggtacctggagtggtgaagtaccgcagtgcttaccaaagttttgtggtgaccctggtatacctgcccaaggaaaaagagaaggcaaaagctttatataccagtcagaggtttcattcagctgcaattttcctttcatattagtgggatcaagcaccagaatatgtcaagcagatggcacttggagtggttcatcacctcactgcatagagcctacccaaacctcttgtgaaaacccaggtgtgcctcggcatggatctcagaacaatacattcggatttcaagtaggaagtgttgtacagttccattgcaaaaaaggacaccttctccaagggtctacaacacgcacctgcctccctgatcttacgtggagtgggattcagcctgaatgcataccccacagctgtaaacagccagaaactcctgctcatgcaaatgtcgtagggatggaccttccatctcatgggtatacactgatttatacctgtcagcctggcttcttcttagcaggtggaacagaacatagagtgtgtagatccgataacacctggactggaaaagttcccatttgtgaagctggttctaaaatattggtgaaagatcctagacctgcactgggaacacccagcccaaagctaagtgttcctgatgatgtatttgcccaaaattatatatggaaaggctcttacaatttcaaaggaaggaaacaacccatgaccttaacagttactagtttcaatgcttccactgggagagttaacgcaacactgagcaatagcaacatggagctgctactttcaggggtatataaaagccaggaagctcgcctaatgttacgcatatatcttattaaagtacctgctcatgcttctgtgaagaaaatgaaggaagaaaattgggcaatggatggctttgtttctgctgagcctgatggagctacttatgtatttcaaggatttattcaaggcaaagattatggacaatttggcctacaaagactgggactgaatatgtcagaaggttcaaattcttcaaatcaacctcatggtacaaatagtagttctgtagccattgctattcttgtgcctttttttgcacttatatttgcaggatttggattttatctttataaacaaaggactgcacctaaaacacagtatacaggatgttcagttcatgaaaataacaatggccaagcagcttttgaaaatcccatgtatgacaccaacgcaaagtcagtggaagggaaggcggtacgatttgatcccaacttgaacacggtttgcacaatggtataacgaggcaacctttgccttcttcagaagcttggaaatcgacacacaaaacagtgcacatttagttcactgctaaacaaattaaagcacacttttcaggacttgctgggtcaccttttcctgaggaatgatacagaagagtgttttttcataaactggaccataattcttcatgtttaccatggagagttttacagaaatttggctgcactctgagagtgcttactcacagtttatttgctttttttaaaaaggagattattctaaaatataaacttatttgcatatattggaggagcatccactatcagtatttctgtgctttataaactatattagagggactgggtttaaaaaaaaagatatagggtagaaataagagctatacttacaagagtcaatagatcactgacttctctttaactgtcctgagctacatcacgcccacaaatctgtctttcataccactctatctgccattcattcttgttaaatgaggcattgttttctttatttaagattgagttatgactttaaatgtttatgagctagtttatgcctcggaagacataaggtttcccattccaatttgaatctttctatttctttagcatcatattgctcttcttcttttagactggttgtcatagtttctgcaaagggcaagttcattgtgctaccctcccaattcccccattatggagtaaccagtattattcagtgagctatggggtagtgtttcactccttgcttcaatatggttttttcctatttatttttattattttttaatcccaaatgtgatagtagcttcagtatgtttcctcacccaaaaaccatttggctggcagaaattatctagaaaaattattattttgcagttatctgagacaccaaacttaccatcctttattttacaatatttttgatcgaccaaataaaatgtcctaataatctactctatttatatctacatttccttccagctgagtcttcaaatttagcattattttgacacttttaattttcatttaacaatggattagaaaaatattttggtctagccactaaacataatgactgaaaaaaattattattataaatcaccaatataaatttattgcctacaattgtggacttatcatatttttatatatttttaaatttctgtacctttattgttaaacaccaagtttcacatacaagaggtttctttcattgtcaaattaagatatgtatttgtaagttattggtggctcatttaaactgtatcatacagtaatgccagcatttttatttaataggtcatcgtcttccttttatagctgttttacttcattgaatacgatcatgtacccagtgttaactctttgttgttgtccctttcaaatatggataactctgtgaacagtcttgactttttgtatcatgagacagagtgcctaagagaaacccttgcacctgggagcgctgcttggctctatctctacaacatttaatgaatttcttgtaaaccactttgagatacattgttttggaaattcatacaattttctcaacatggtactctactggcaggatgcagttttaaattttatgccatcagttatttattcttgtttattcaaatgactgcaataacaatgattcattcattaatgttaaggctaatacatttaagatcttgtttaaacaatgtttcttctgcaactggctactcctcttatattaatgcatacacttttgtaaagaagtatatttttatgaaaagaaactttgtaaaagtatgatgtaaattttcagtgcaatgtaaacaaaataaaaatggataattgcttttgtaaaaaaaaaaa

SEQ ID NO: 9293 - DNA, 427 bp, Homo sapiens
aaaggctttagaaattcagaaattcttctgaaaggctctaaccacatagtacttttggaagttgagttttttggttttgtttttgttttatttggtcatagaagatgatcgctgtaaacgttcaaacaatacagaaaaagtgaaattggccgggcgtggtggcttacgcttgtagtcccagcacctggggaggccaaggtgggcggatcatgaggtcaggagatccagaccatcctggctaacacggtgaaaccccatctctactaaaaatacaaaaaattagctgggtgtggtggctcgcgcctgtcatctcagctactcgggaggctgaggcaggagaattgcttgaatccgggaggcggcggttgcagtgagccgagttcgtgccactgcactccagtctgggagacagagccagactccgtct

SEQ ID NO: 9294 - DNA, 356 bp, Homo sapiens
tctgtatatatatatatatatatatatatatatatatatatatatatatatatatatatatatattaaaagtatagtttaggtttacataaagacaaagtatcataaaaaggggtcttacaatcggtagtactaaaaaaatttttaaactccaagatcttcaattttaatatataaaaataataaaacatactgataaataacagaagttctatagtcagacaacataggttcaagtttgggcttgatctcaagtagggtttcaatgtttaaaaaaaatgccatgtggtctttccaacttcatttccttatgtaacataggagataataataaattcactgtgattaagagttaaa

SEQ ID NO: 9295 - DNA, 629 bp, Homo sapiens
atgtggtgctgaaatcaagacttaactttgaagtgtcaagaatgataacctcccatccacttcatgtgatttttaagaataaattttatatatttctccaggtattaaagtggatgtccacctttgccatttcagaacctaaaggcagaatctaatggtaaaatgaagacaacctagttgtcttctaataacctagttagttctaataacattctcaaatattttcatctagagtaaatatttactgttggctttgtattctgggaattagcccaagactatgctgctcaaatgggtgcaaatatactctcaggttgcaatagcatgacgagtggtatttgaagcaataattgttccatcttggattatcggttttgctctttgatttggtaaagtttttgtttttctactcgtgccagttgtattaaaatgtcactaggttaaaaacaaacacagatatgtttattcattactgtatccctgtaataatgcctggcatgcagtaggtccctaatatttgttgaatgaatgaattatagaatagagtgcaaaattaattctaatgtattttaaagtaaagcatgagagttcaaagaaatgttgtatttgccatctacaacttggaataa

SEQ ID NO: 9296 - DNA, 397 bp, Homo sapiens
gaggcagggtcttgtcatcttgcccgggctggtcttaaactcttgagctcaagtgatctacccacctcagccactcaaagtgctggaatcacaggcatgagccaaggagggaggaccacatgagcccaggagtttgagaccagcctgggcgacatagcgagacctcatctctactaaattaaaaaaaaaattagcccagtgtggtggtgcatgcctgtagtcctagctacttgggggactgaggcaggaagattgctggagcccgggaagttgaggctacagtgagccctgatcgtgccactgcactccaacctgaacaatagagcaaccctgtctccaaaaaaggaaaacagaaatggtctagtctttgctgtttcactcccatgttggtgccact

SEQ ID NO: 9297 - DNA, 384 bp, Homo sapiens
gcaaatgtctccaaacattggcatctgttgtctgccgagactaggacaaccgagaatgatggagtgcttaaggaaattaggatggggcatgcgaccctgtaacagctgataaactgtttcaggccaccgtggctcatccagctcttttgataaacagctttaaaagcattacgtggtttggaaagcattcttcaaaaatggttatattttccagacgcatgacagtccactgttcagtattatttaagggttttaaattgtagaatcagattccttttcagtggggctcttggaactgtcgagggctgatctgtctgactcccaccaggacaatctcacaacaatattattatgtaggtcggggtcccctaggtctgttaaaaa

SEQ ID NO: 9298 - DNA, 618 bp, Homo sapiens
agaatttattatgtatttcaaaatagccagaagagaagatatgatgtgttcctagcacaaagaaatgataaatgtttgaggtgatggatatcctagttaccctaatttaatcattgcacattgtatgcatgtacaaaaatacatattccataaatatgtacagcaattatgtaacaaagtttacataagggtctctgacagaagaagcattttcccacattgcatagtgacagccaaaatcttaataggtacaataattaaagttatgaaagaattgctattgaatgaagaaaatatttgtctttagtgctttactttagattattttgagaggactatagtgtatagctaagaagcaatcattcaactcagggtaggtgggttaggtttaagaaaatctgatgactccattgagaattgtattaaagctcagccaagagagctgagctgtaacaatatttaatttgccacattgcagtttcatccatctagaagtgtaggaaattcaggttttcaggttcactcaggatatgaattgttaacttcctcttagcagagataatatattactatttaccagataatcttaatactctaacttatatttttacttcagaa

SEQ ID NO: 9299 - DNA, 359 bp, Homo sapiens
cattagcacaaggagactctctcctgatgacagaggtggatctccagtgaaaggaaccaagtgaaggtaaagcggtacaaggctttgtaaccatagttactttaagtctaagattttaaagctattgtttccattatgaaagatgcattaacattcctttatgtctactcttggaaaccttgttatcatgactagcctatttacttacttatctcttaagaggtggttaggcttaattaattcttaaacattaaccttgaagatatattctggagggtgggagaagggttttactctttgaaaatgggaaggagtaaactcagtgaaatgctcaaattctgagagtagcagaaacttta

SEQ ID NO: 9300 - DNA, 604 bp, Homo sapiens
tagtggtctctgttttcaatataattcttgatttcatttttctctggaatatattggccttctacagctattactgaattacagaaactggtttatttctgtcagaaagctgcagtgccacctgagttccaaattttaacattctttgtaaacggatggattatgataaagaagatgctaccaatgaaatagaaaaccaacgagatgagaagactgtgatcctcatgcactcagaggcacttcccttctaagtcaaagaccattctcactgactatgtgccaaggcctcacttcaggcttgtgactcaacaaagggcttttccattgatagaagcagtttgggatttgtagctacaacttcttcgatagttacctgcatgtccattgctggcagctgacttcagtcattaaaacctggctctttggttaagggagctacactgtggtttattcttaagttacatggataaactaacctctagcagaaatatagtttggttaattttgagatgtgtcatttttaaacaaaatcttaaaagcaatacagaattgtgatttattaattttaaattaaaacattgagaacttgttgaaagaaaaatta

SEQ ID NO: 9301 - DNA, 1314 bp, Homo sapiens
accacaggaggattgactacatagcctgctttcatagcttgtgtgtatttatccagtgccctaatagttgatactgccagtgatttactcctgtggagtaaaggtaagcatgttttagtttctggagtattatattgtacgttggagctaggtatttaagaatatttgggggtggggagggaagactccaatttactggtggtgcttggccagtaatcaaggtgacagtttaagtattgggtcttgcactgtaaactcctgcttatctagacttcagactaccacagagcccacacagccaggaagtctgtctccccatttagtcttatgagcaagatagatgaagccatgagaaaatatactcaaaaagcaaccaacagacaatgtcatggaatgaatctcctacagatttttccttacacttttgaaaagtaacatgattttaaaacgttggaaaattcatcaaggtacaaatcattttctgacttcagcattgatacctaaattgatttccagtacacagttttatagaattgtgaatatgtagtaatctcagttaaccagaaccttaaccttcaggttaaggaaaatacctattccttaacctctaggtaaatgggagtttaccttacaaagctgattgagagcttatttaaaacgtaaacatacaagatgtcattgcttccttgtagtgaagtgaaaaggaggtattggattaagcatttaaagttaattaaagtagtggctcgtgcctgtaatcactggctactcagaagtcttgaggtatgaggatcatttcatgccaggatttctagaccagctaggcaacataatatgacccctgtttctttaaaaaaaaaaaaaaaaaaaaggctagtgtgttggggggtgtgtttgtagttgtagttacatctactcaggaggcagaggcaggagaatgtgttgagcccaggaaggagctcagggctgcaggaagctatgatggagccactgcattttgatagtgagacctggtctcttaaagtgttttatttttaggccaggcgtagtggctcacacctgtaatctcagcactttgggaggccaagatgggtggatcacctaaggtcaggaattggagaccagcctggccaacatggcgaaaccccagctctactaaaaatacaaaaattagccaggtgtggttacatgcgcctgtagtcactcaggaggctgaggcgggagaatcacttgaaccctggaggcggaggttgcagtgagacaaggttgcaccactgcattccagcttgggcaacagagcaagactccgtctca

SEQ ID NO: 9302 - DNA, 391 bp, Homo sapiens
tacacattcatgcaaacatttcatgtaagttttcttccttaggacctttaacgatttttcagtgatgcagtgatgatatgtaatatataataaataaaatcaggccaggtgcagtggttcacacctgtaatcccagcattttggcaggcgaaggtgggagaattgcttgagctcaggagttcaagactggcctgggcaacatggtgaaacctcgtccctactaaaaatacaagaaatagtcgggcgtggtggtgcatgcctgtagtcccagctactcaggaggctgaggtgggaggatggtttgagcctgaaaggcagagattgtagtgagctgagatcgtaccactgcattccatccagcctgggcaacagagcgagaccctgtatcaaa

SEQ ID NO: 9303 - DNA, 500 bp, Homo sapiens
cacagtggcaccgaccagcatgggaagagtttttgtgctgacagcagggcattctctttgttctgtggtccatttgtagatggctgcgctcctctgcacaggggctgtcgcttctgcatggattggtgtctaaaaaccccacctaaatgagaattagatattccctttcttctttacccagaattttctttttataaataaaaataggctgggcacagtggctcatgcctgtaatcccagcacttttggaggctgaggcaggaggatcgcttaagctcaggagttcaagaccagcctgggcaacatagtgagactgtaccactacaaaaaataaaaaaacttagccagatgtggtggtgcatgcccgtagtccagctactagggaggctgaggtgggaggatcacttgagcccaggaagttgaagctgcagaaggttgtgatcgcaccaccacactccagcctgggcaacagagtgagactcactctctctcaaacaaaa

SEQ ID NO: 9304 - DNA, 864 bp, Homo sapiens
ctcctttcttgctgctacgcctcaactatttcattgcttgtcaatgctcagcaaggaagacagcctaacagcagccctcccacctgtgaattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggtttgttgttttttttgtttgtttgtttgtttgtttttaatgtccattatgggatggtctgattagacaatgggatttcataatctagggaggtgagcacatccctgagttttgccaatcctcattattcaacctcctgctgtgctcaggggtggggcttctacacaccaggaaactccagataaatggaagcacaaactgctctgcccaaagccacactctgtggtgccaaagctggcagatcctgccattttacagactatggcctccaaactgggttttcctctttttcatccctgcaaagaataagaaagcacatagtcccaagtccctttctcaagatgaccctccacatggacacctgaagcgatcaaacagcctccgaccaagaggcatttgttatttactccacacaccatcctctagcttgttgcaaaacctgtctgccttctcacggt

SEQ ID NO: 9305 - DNA, 364 bp, Homo sapiens
  misc_feature (27)..(28): n is a, c, g, or t
ctgattcccattctaacatacaaaaanntgtttgttactcacaattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggttt

SEQ ID NO: 9306 - DNA, 369 bp, Homo sapiens
ctctcctcacctaactcggccaccaaaatagaaaagggggagcctcaaattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggttt

SEQ ID NO: 9307 - DNA, 365 bp, Homo sapiens
gaagatattactatatcgaggtaaaaaaaagagacttaatgataattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggttt

SEQ ID NO: 9308 - DNA, 362 bp, Homo sapiens
cctccacctgttctcagcgaagaaacagaggaacttcttcaattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggttt

SEQ ID NO: 9309 - DNA, 366 bp, Homo sapiens
caacacttccaataaacgttacaacacaataaccgcatctctagaattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggttt

SEQ ID NO: 9310 - DNA, 358 bp, Homo sapiens
cgagcttgtaagttgtctaaaataaagggaatccagaattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggttt

SEQ ID NO: 9311 - DNA, 344 bp, Homo sapiens
ggcttgttggaaccgggatccaaattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggttt

SEQ ID NO: 9312 - DNA, 900 bp, Homo sapiens
agcaaaatgtcagggaggagagaagcatggcctctcgagacaaacccaggctgctaagaatgtaagctctggtctcactttgcgttccagccaaacacctaagtgctcctttctatgaccaaagaattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggtttgttgttttttttgtttgtttgtttgtttgtttttaatgtccattatgggatggtctgattagacaatgggatttcataatctagggaggtgagcacatccctgagttttgccaatcctcattattcaacctcctgctgtgctcaggggtggggcttctacacaccaggaaactccagataaatggaagcacaaactgctctgcccaaagccacactctgtggtgccaaagctggcagatcctgccattttacagactatggcctccaaactgggttttcctctttttcatccctgcaaagaataagaaagcacatagtcccaagtccctttctcaagatgaccctccacatggacacctgaagcgatcaaacagcctccgaccaagaggcatttgttatttactccacacaccatcctctagcttgttgcaaaacctgtctgccttctcacggt

SEQ ID NO: 9313 - DNA, 815 bp, Homo sapiens
atagttatgcaacatatatataagaaaacggaacttgagaattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggtttgttgttttttttgtttgtttgtttgtttgtttttaatgtccattatgggatggtctgattagacaatgggatttcataatctagggaggtgagcacatccctgagttttgccaatcctcattattcaacctcctgctgtgctcaggggtggggcttctacacaccaggaaactccagataaatggaagcacaaactgctctgcccaaagccacactctgtggtgccaaagctggcagatcctgccattttacagactatggcctccaaactgggttttcctctttttcatccctgcaaagaataagaaagcacatagtcccaagtccctttctcaagatgaccctccacatggacacctgaagcgatcaaacagcctccgaccaagaggcatttgttatttactccacacaccatcctctagcttgttgcaaaacctgtctgccttctcacggt

SEQ ID NO: 9314 - DNA, 818 bp, Homo sapiens
  misc_feature (27)..(28): n is a, c, g, or t
ctgattcccattctaacatacaaaaanntgtttgttactcacaattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggtttgttgttttttttgtttgtttgtttgtttgtttttaatgtccattatgggatggtctgattagacaatgggatttcataatctagggaggtgagcacatccctgagttttgccaatcctcattattcaacctcctgctgtgctcaggggtggggcttctacacaccaggaaactccagataaatggaagcacaaactgctctgcccaaagccacactctgtggtgccaaagctggcagatcctgccattttacagactatggcctccaaactgggttttcctctttttcatccctgcaaagaataagaaagcacatagtcccaagtccctttctcaagatgaccctccacatggacacctgaagcgatcaaacagcctccgaccaagaggcatttgttatttactccacacaccatcctctagcttgttgcaaaacctgtctgccttctcacggt

SEQ ID NO: 9315 - DNA, 502 bp, Homo sapiens
agcaaaatgtcagggaggagagaagcatggcctctcgagacaaacccaggctgctaagaatgtaagctctggtctcactttgcgttccagccaaacacctaagtgctcctttctatgaccaaagaattcttcactgattaaaatctggttacaaaacaagggacctagagagatgttcacttcaccacttctctacagatgcctcctgctgcttccaacttttctcctttaaggcagggtgaatccaaatcatggtcttagccctgaaggaggcaccaaagcagtttcgttgccctgtgaaaagcttctagaggagctcatctgaatgcttgaagaaaccagccgcccttgcaattacctaaaaggaattgagtcattttaacaagacattatttctgccatccacggtcacaatcatctctttgaaaaataaatactcttggtttgatcggcagtccaagtattctatgaaaacaatgttagtatctatcgacatattaac

SEQ ID NO: 9316 - DNA, 587 bp, Homo sapiens
gtaaagagcaatcaattttataaactaaatacaaagaaaaagtcaattttaggagatctttcttccagttaaagaattgagaaaaggctacagaggccctaaaaattagagtcacactgttgttgaaacttggggaaagacagcattttagggttgaggttctcagttctataacaaggtagacctggatagtaaagatgttagaaaatccttttttaaattttttgagacagggtctcaccttgccgcacaaactggagtacagtggtggaatctcggctcactactgcctcaacctgctgggctcaagccatcctcctgcctgagcctgccaagaaactgggactacaggcagacaccaccactacacccatctgtttcatttttggaggggggcgtggtttgtagagacagggttttgccatgttatccaggctggtctctaactcccgagctcaagcagtccacccacctcagcctcctaaagtgctaggattacaggcgtgagctactgtgcccagccaagatgttagaaaactcttgactctgggtagcagcataactgtccaaaaaaacacaaaacaaaa

SEQ ID NO: 9317 - DNA, 494 bp, Homo sapiens
tttatgggataaataatattttatttttataataaaatgtatggggagggagaaagtcaggggagccctgacaagtctttctgtaccttcttcgtaagtctggcattacagattaatggaacattttgctagagggaatttgattctgcatatagggctaataacaaggaaaggaagcatttgtaagcaatcctgtaaagacgttttagaaataaagtatatcaatagatctaatagcaggtatccagaagttataaaaatttatggccataatattttgagcctttttttttttttaacaatcttgaatcctgttagttctgaacattaaattattgaggactttataaatcaaaactaggctggacactggtggctcacgcctgtaatcctagcactttgggaggctgaagtgggcagattgcctgagctcgggggtttgagaccagcctgttcaacagggtaaaaccatgtctctaataaaatacaaaaaa

SEQ ID NO: 9318 - DNA, 481 bp, Homo sapiens
gatactttaggaagcgggaaatgtcttactggagatagttccttcatttcaacagtcatttgtgatactgttttttaatatttgccataggatagttaaaaggtaatggaacaaacttcagatttataagtttttaattaaatataaagggggcaaaagtagataaatatcttaagagctcaccttactgtctagaaaaaatacttgctggcccagcgccgtggcacacatatgtaagtaatcccagcactttgggaggccaaggtgggaggcttgcctgagcccaggagattcagaccagtctgggtaacatggtgagacccccatctcaacaaaataaaaaattaggtgtggtgatgtgtgcctttggtggcagctactaaggaggattgcttgagccaggaggtgaagctgcagtgtgctgtgatcccgtcgctccactccaggctgggcgacagagcaagaccctgtctcaaaaaaa

SEQ ID NO: 9319 - DNA, 413 bp, Homo sapiens
acaggaagggagcttaagctataatgtatgctgtgtgttcatccaggctgttgagcatacaaagtacaagatatatttaaatgtgtacatacatgcctaatcaaattcactcctattgcttttttcaatcaatcaatttaattcattttcttcaaaatcacagccaatagagccccctgggtgctcctcttgtatcccactgtgactctaggggttcctcacgactctgacataaggtacataacgaagttaatgttaccaaggcataaccgacccagtaggctgatttataaatggaacttgtggagggccagcaggcatttccctacagtctttgatttatacatgcactcattcagtagtacacagaaactgcattcacaacatccttaaaacaccataagctagaaggg

SEQ ID NO: 9320 - DNA, 409 bp, Homo sapiens
aagaaacatgtaactgcctcccacccccagccatgaaaccagaatgcttaattgtaggagtggattttggtaacaaatcgttttgaaccatatgatcacagaattttctgagcatttctatcagagagaattctgatagaattggaccctaagtcttacctaattggctatatcaacggctattctatggtagaagggtcataacctaagtgatgaaaattatgcttttcatttgatagtctgaagatttgagattctatgaagagggagggggagaaagtggaataggggtgtgagacacataagataatgaaggggctgctgctgaaactggggaaagcatctaaaagcatgagttttcagaatcttccattcagttttttctataggcatgtaattcatgtattgt

SEQ ID NO: 9321 - DNA, 363 bp, Homo sapiens
agatgaggtcttgctatgttgctcaggctggtctctaactgctgggctcaagtgatcctcttaacctcccaagtagctgagactacaggtgcacatcattgtgcttagctaaaaaaaaaacctgttctaaagttattcctaatgatatttatctctataagtctggtactatctttaactgactgcagttaactacaagaattttcaggcggataacaaacaacaataccatcaggcattgtcaaaagcaaataaaacctgttgctttggggaggcatacttacctagcactatttgaattttcatttcagtatgaactttgtttcttcaaaaaggaagcttaactatagatccagaagaagg

SEQ ID NO: 9322 - DNA, 552 bp, Homo sapiens
gtcgaggctgcagtgagctgtggctctgcactctagcctaggcaacagagtgagatcctgtctcaaaaaaatatatgtatatattaaaacctaatatatgtaactactttcatgaaaaaattgaactaaaataattgagactgctgctgtatattttgtgcaactaaaataattgagactgctgctgttatgttttgtgcaattgaaattagatttggtatgttttaaacagctcattctagacagaagttaactgaaattcataaatgttcttagttattccctgccaccctttccccacacacacacttgaactgttctgcactttgaaacacaaagcaacttgtcagttcagtttattcagtcagggtcagttctgtgaaaacaaagccaaggcaattgtttgatttaattgactagacaaactggttatacaggttagtagaacttagttttatttttgtccagctgcatatttgaatgttcataaagtaacttagtaaaataataagattccagtgacattgtaatatattttaaagaataattacc

SEQ ID NO: 9323 - DNA, 570 bp, Homo sapiens
ctacttctaaatactatcaaactggcaacacccgaattttagagaggacacaaaccatgacatgattccccctctattcttactcaaagaaggaaacagacatttcaataatatcattctctctttcacaagtcagcaatgagttaaatgcaaggaggggacttaccctctgctctcccttcaggcttaggtctgattcaggtgcctgagacaatactgtcaaagaatagagaaattatcttgctaggcagacacaagaaaataaatttagccctgacaatgtgtggtgattaagtacttgaatgacaatggaacatgacaatgacaaatgcaggctactgccaccaaagtcattaatatatcagaaacactaatttttataaatctttcaacttcccggttggttgcatttcttgacctactctttttcctgtggaactgacttagagtcagcatcattttcagtttccaactgggaagttaaaaaaacttctacattcccagtggctttgattggccaccaaaaatgagctgtaagcaagagatgaatggcctgggtatgctcgagtg

SEQ ID NO: 9324 - DNA, 300 bp, Homo sapiens
gaaagtcttgaataatgttagcatgagagatcaacttcccagaatatatatttatagattaaatcagtgtggtgacccagcaggtggaaacattctggtaatattttggaataccagtcttccttatggtgagctctgcaattacctagcggtgtaacagtatactacttgtcctttgactgatgtactttttaagtgttttgttgatttcctttggagcagtcaggtctttaatttcttcatatcttccctccttcttagagcttcctccaccctccatcacacaacaatagttatgag

SEQ ID NO: 9325 - DNA, 432 bp, Homo sapiens
gaaaagcagtttttttagagtgctgggactggaaagagtgggaggaaataatttattcttatatatatgaataatagatgtattaatagttctgaacagtagtctcagaaatagcacttacactactaaaacaagtctatcgtgctattcaagtagaatgcaagtttttaaaatgtaggataaatctataactcaaaataagcaaccagcatagagttggtattgtagtttatgatttgcgcagatggggatttaactcttttttccccactgtatgtgattaaaatgtatcagactcatcttgagtacatattcatcataaattgtaaagcaaatgccagttttctaaacctttacttaaactatttgattacatgtaatttttatttttacttaatgaaaaaaaatgatggatcataaactcttttgttt

SEQ ID NO: 9326 - DNA, 379 bp, Homo sapiens
aaccagatgtatcttccagagttatttatgggtacacattgtaattttaggacagatttatttgtaaatgaagtaatgtataagaaagcattttgggctgggcatggtggctcacgcctgtaatcctaacacttttgggaggccgaggcaggtggatcacctgaggtcaggagttcgagaccagcctgacaaacatggtgaaaccctgtctctattaaaaatacaaaaattcaccaggcttggtggcacatgcctgttaattccagctactagggaggctgaggcaggagaatcacttgaacctaggaggtggagagtgcagtgatccgagatcgcctcattgcactccagcctaggcagcaagagtgaaactgtctca

SEQ ID NO: 9327 - DNA, 840 bp, Homo sapiens
accctctcatcagctgtcaattctcagtttaggtctaaactaattctattctcaagattccaagtgagagcattatagtaaaataatacatctcttaagtcatatctacccagttcacattcagtatcctctcagttcagaatcagaagctgtcagaccaacaagtagaggttcctgcacaagcctgagagagatcctgtaacttgtgccttggaaaaacagccccacgaaagaatgcccagacagatcttctcttagcaaacatggtgacttgagctctctgaatttgttcccttatgctacattgtttgttttttaatctctaaaaaaactaaaaaaaatttcaggtaaatttcttcctttttcattatggtttgaattagggtttttgataacttttttccaaattttagggatgttaaaggttcaggaaagtataaagaagaaaataaaaatttcccataatactgccccacaaataataattataaatattttgatgctttgcctatttgagttatttcatcatcattaaatgctcttttattaaaaatgactttaatggctaaatacaaatctgctgtaccagaacttatttaactattccctttattgtttgacaattatttcctctttcctatacttttaatgccatcatctttgcatgaaaaatcttttatttctatttgatatatgtgataggcattcttccatgcttattacaagggtttaataaaagttatttcaatttaaatgaacaaattatttccttttgatagattccaggaaaggaaattattgggtcttaagatatgaacaatttaaagcgcttgttatgtg

SEQ ID NO: 9328 - DNA, 443 bp, Homo sapiens
atatacaatttgcatatagtcaatttctgcctgtttgggaactgtaagtaaatataatcatacataagcattcttccaagacttgctctagggtcaacatgatatttctgagtgttatccatgttgatgccaagagatgttgataattcattttcacagctgtatagtatcctattgcatgaatgtatgacagtctatcatttctatcagttggcagtgctaagtcattgacaaaaatgatggttcagagttaggatttcaagaaggcacaattgccaccaaatttatccctgtttcatgcacaaactacttgagcagagaagtgaaaattttgcctcaagttagaagcaggttttagctaggggacatcaaaggagggaaggggtcttaaatgggagaggaagaaagggctaaagtgactccccaagattaaaaaataaaaa

SEQ ID NO: 9329 - DNA, 998 bp, Homo sapiens
ccattcacttagccaaagtccagcaatgcttctttaataacaggacagtagatattgtcctgttaatggttagtgtataatgagcccaagtgtgattcttcccatttgggaattctgtgaatcctgctgtaggttgttgcctgtctgattataaaagactaggctcatgtttttgctttaaatgtttgagattatggtcttataccttagtgcttctggggcaatctgaacattgtttgctttgtaaaataatttcttttagagtagtctcatgccaaatttactggcctttgattcagtacagttgggtttactgtatgtagtaaagttgagaccctgcgtagattggtctcagtgttagcattcttgggagcctttgacaaatttcccgagttaaaaattccagaaattgatgtccccagatctttagatgaacatttaagcgaagagtattaaatacttctcactgtaaattttcatctattatgaaagatactaaaaataatctcgttttttaagtttggaattgggagaatgtcattgaagtttttcagtgcttgtttttgagatacacatactttgccttaaatctggggttttttcccttaagccatgtgaccctttctacaaactcagtgtatgtttttaatatttcctgggtactctgctatcgtcctaatacataatattagggtaaggctgccctaatacgagaacattttgagtatactattgagtatacatttgagtatacatattgagtatactatttatgccaacgtgaaggatgtgattagttttagccttcaagtcataatacataccatgcttgaaagcatttaaaaaggaatagagtaattttttttcccattccacttggaagctgtgtacctcaagtgtgtgcacatttacaaatgggtgaaacataacttatgttagtccaagcttgatttgacttcagttctgcttcaacgttttagtagatagggcactgaact

SEQ ID NO: 9330 - DNA, 243 bp, Homo sapiens
attctgcttttgaaaatcaaaatcaaacatgaaacagtatgtctctctgtaaagaagtcagatatcttgttgggatattactttggctttctgccaaaaaaaaaaaaatctctattctcctaactctgaagaaatgaagcaaaaaagatatttgaggaaggaggaggggattgtgattgttttattgagactagaatccagatttgcaaagcagcacttcttttttttaactctaacccagac

SEQ ID NO: 9331 - DNA, 231 bp, Homo sapiens
ttagtatctgccctctttaaaggaaatggctcctgcctagaaggtcagatggattcttcgcgctgtgaccctttctccttgaaggacctacacctcctgtgaagaccatttcggacttgacctccacctgagtgcagactttgttcagaagtacacgcattgcctccagccacccctaccatgtttgatgggggattggttactgccagagcatatgagcattttaaccca

SEQ ID NO: 9332 - DNA, 803 bp, Homo sapiens
tcgggtcctttcgactgccacctccctgatgccatcccgtccctacgcctgccctcctgggttctgggcccgaaagtccagtcgctgagttccccaggagccctggccattccctggatactcagaggcaaaagggccaaatccttcacagctggctactgtggggacacacgcctgcctcctgcctctccaaccacaaatctcgatgccaggtcttcgcataggaatgaaaatttggaggtcaagggactagaatgatcacatatgccagggttggttaagcaaacagatacacaacgtcaggtggcgggctgacatcgaatcagtgccgtctgacagagatgaggcagagaggatgacagatacacaacgtcaggtggcgggctgacatcgaattgtgctgtctaacagagacgaggcagagaggatgacagtccccgcctccacagacacaaaagcccagctcaagggcagtttcagggcaggacagggctattgggatggggcagagcctggattgggggccctgcacaagcaccagggctcaggcacctgggagacagtgggagtacaggttagaaaggaactttctaagtattctgaggctaacaatgaaaactggaaaggggatgttaaattcctaaaaaacatcaatacagaaatactgctctaggccgggtgcagtggctcatgcctgtaatcccaacactttgggaggctgaggcgggaagatcacgaggtcaggagatcgaggccatcctggctaacacagtgaaaccaccgtctgtactaaaaatacaaaa

SEQ ID NO: 9333 - DNA, 503 bp, Homo sapiens
  misc_feature (500)..(501): n is a, c, g, or t
aggctttaaagaagtttcttggccaggtgcagtggctcacatctctaatcccaagtagctgggactacaggcacgcactaccacatctggctaactttttgtattttagtggagacagggtttcaccttgttggccaggatggtctcgatctcctgacctcgtgatccgcccaccttgcctcccaaagtgctgggattacaggcatgagccaccgcacccagcctaaaaaacatacatattttttaagtttctagaagcttggtcccatgacatctgtataatctcattggccagaacttggtcacacaaccattcctgctgctgtggagccttatgaagttaaaaatcagggttttattatcaagaaaggaagagagaccagatattggtggtcagttagcatcatgtgccaggaccaggtagtgtttaatcttagaaatgcaaggatgatttaaaatgggaacatccgttagtgtaactcattacattagcaaaaaannaa

SEQ ID NO: 9334 - DNA, 437 bp, Homo sapiens
cttagatacagtaaaaaaaaaagaaagaaaaccataattcataaaagaaaaaatggataaattgagaatgtaaaatggtacaactactttggaagacagtttggcaatttcttaataacctaaacatatacctaccatgtaattcaaccagtctgttcctatctttttaaaccaagagaactgaaagcatatgtaatacaaagacctgtatacaaagcaactttatttgtaatagccaaaaagtggaaacaactcaaataacttaactgtccatcagcaggtgtgaataccaaaacaaattctggtatatccaggaatggactactactcagaaaaaaagttggtgtagggaggtgttgagggaactgttctacatctcaattttggtggcacttacatagctatatgcatttgtcaaaactcacagaacacttcac

SEQ ID NO: 9335 - DNA, 447 bp, Homo sapiens
agagattatactcatgaaagagaatgttagtgttacagagaagcagccgataggaaatcaactgtagagacttggaggtggcggcatcgctccaggtcatcatcagtgtggtgttatctatgagaacttgagcgacagagtatttcttgatgaatttatagatcatttgagatgttgagttacttttgttttcaaataggtagagactattaatttaaaaaaacaagaaaggaaaatgaaatgtgcgtgttgagagcaataatttgtttcttttaaagattctgaaagatctgagacctgtagcattaattatttgagtgccctcccttctcccctcccctccctttctcttctcttctttcatctcctctccttctcctttattcattgttttgctttggaataggttgttcaagtatttggtttggttctggcattttgttccca

SEQ ID NO: 9336 - DNA, 405 bp, Homo sapiens
actagttagaaaaatgcagcatttgcctagagacctctaggaacccacacaaatgggccacatccattttggcttccaggaaatgaccagcactgaggaacagctaagagaagaaaacaatctttgcccagggattgtgaaccaccaaacccatggacccttactgatgaaagcatctgaagtctttaaaagcagttaaagaaaaggagtattcctggcattatttagtcccaggttgcacaagactctcctggagatcaagtcagtgctttccaaattgtagccaaaagaaaatgcacgggaggctgaggcagaagaatcgcttgaacctgggaggtggaggttgcagtgagtggagatcataccactgcaatcctgcctgggcaacagtgtgagactccatct

SEQ ID NO: 9337 - DNA, 939 bp, Homo sapiens
tccatgaagagagcactgtatacagtcagatgacctgggctcactagcctctaagcatagtcttggtttcctgcctgtaaattggtagaataagactgatttactgggcctggcatggtggctcacacctgtaatcccagcactttgagaggctgaggcaggaggatcccttgagcccaggagtttgagaccagcctgggcaacatgacaaaaccccatctctccaaaaatacaaaaattagccaggcatggtggtgcacacttgtagtcccagtaattagggggctgagacaggaggatcacttcagcctatgagtttgaggctgcagtgagctgtgattgcgccactacactccagcctggatgacaggacgaaacctgtctcaaaaacaccaaaaaacaaaaaccggtctcctggggtcatggtagcacaaacgcacatgactgagtgctcaggggttctgaggcttgtccgctgacctggggctctggccctgggagatctgggggacctgctgtcctatatgtgatgctttgaaagaaaggggcatcattccaagccaagaggccccagagagggcaccgtggggtgttcaggcttctgtgaggccccagtgagatcctgtggctgtgcccccatcacctccacccactctgccctcccactagctgcccaacggatgaatcaacgccttggcagagttttccagcagggccttgcagagagtgtgtgtgacctgtgtggccactgccttggggacgggtgaggagttagcctggaacattccagcgtgggcattattgtcctgttgcaagttcagggcaaaaccaggaatccagttttgtcgatccaattgagaaaacatttcatgaacaactacttgtggcatgcattggcactcggaataaagcgcactattgtcactaggttggcatttc

SEQ ID NO: 9338 - DNA, 4768 bp, Homo sapiens
cttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactattggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggattttagcatgaattccagctggggagtcttaacagatgccccttttactgatagagcacctaaagcgatctttggctccataggaccataggaagggtcagtacagaagaacctagatactgccctgcccctgagaactgtgtatatgtggggcctgtctgcagcacccatctcaggtgggttccagagggcctttagggtataatgagagcctgttaggtggaagaggcccagttccagaaatgttccagcccacccctgagaattcctcctgtttagttgtgtgggaagccctcgtcttccaggctgtccttgcgccttgaacctggagaagtgagctcactgttctcaatacttcacaaatgtaaaactttctttcgtctgcatgtgctcagccatctaaattgagcaaatgatctggtgagcactgggttagaatcaggaatggtggaatacaatctgaacctctcagagcccagaacagagggttcctgacactgtgacactgtctcctggaactaagtatctcttgaatcatgacttggttttagatcagtcaagagagacccaggttttgccaggaatcgaatccctaaataacatgtttttttctcacttagctcatgaatttgcatagtagacagtagttctgaattagattttgaaaacctaatttcagggctcattttttcctgtggccctaaatccattctatcaaattgtgtgatactgacatgcagtcatctgaggaactcagcgtagatacttgagcagctcctcgcctcttttctaactcaagtttgactaaaatacatacactccgtacagaaggtagggggttatgtaagaaaggaaaacctaatctatggaatcaggagttgtcaccaccgagcttcctctggaagtctgcccatcagcttgcttgttctctgttaagaggaagggctaggacaaggatttgggcttgaatatgtggaaaggaattttcatagttgttgctgcaggacctacaaaagtttaaaattagattggatgtgactcaatgacaagtcccatctgtgtaattgttaaggggacctgattgactcctgtggtttgattgagcaaccaggtaaatagagacctctctccagctttggcaaaacccatcagaggctgctgcagaactcagacagagggatctgcccttgggtttgcttccatcctgttccattgctaagcccttgtgacttggatcctaggactgaaaagtttttagctgcctcagctttcccctgaccttactggcagaggttctgcagatgtttcctttggaagatctcttgccaagaatagcattcctttggaggaggggggttctagttggaatgttgcttttcttggttagtgtaaatgtattgctagtgagacagctgccggcgctggaaaaggctcgtctcacagggagagtgctggtccccagaatgtgtgctgttcccacgctgctgcctttcttgagcttgttagaggaaagccagaaaggcattcagatgggatcagtctggctttcaaattttttttaattcctaagttctgttttattttttaattttttaaaaaaaattttattagagacagtctctctctcttgcctagctgggagtgcagtggagtgatcatagctcactgaggcttgaactcctgggctcgagcaatccacctcagcctccagagtaggggagactacagatgtgtgccaccatactcagctaatttttaaactttcgtagagacagggtctccctgtgttgcccaggctggcctcgaactcctgacctcaaaaaatcttcctgccttggcctcccaaagcactttgagaggctgaggcaggaggatcccttgagcccaggagtttgagaccagcctgggcaacatgacaaaaccccatctctccaaaaatacaaaaattagccaggcatggtggtgcacacttgtagtcccagtaattagggggctgagacaggaggatcacttcagcctatgagtttgaggctgcagtgagctgtgattgcgccactacactccagcctggatgacaggacgaaacctgtctcaaaaacaccaaaaaacaaaaaccggtctcctggggtcatggtagcacaaacgcacatgactgagtgctcaggggttctgaggcttgtccgctgacctggggctctggccctgggagatctgggggacctgctgtcctatatgtgatgctttgaaagaaaggggcatcattccaagccaagaggccccagagagggcaccgtggggtgttcaggcttctgtgaggccccagtgagatcctgtggctgtgcccccatcacctccacccactctgccctcccactagctgcccaacggatgaatcaacgccttggcagagttttccagcagggccttgcagagagtgtgtgtgacctgtgtggccactgccttggggacgggtgaggagttagcctggaacattccagcgtgggcattattgtcctgttgcaagttcagggcaaaaccaggaatccagttttgtcgatccaattgagaaaacatttcatgaacaactacttgtggcatgcattggcactcggaataaagcgcactattgtcactaggttggcatttc

SEQ ID NO: 9339 - DNA, 184 bp, Homo sapiens
acgaaagggcgactccacaagggcgactgcttagaagttactaatttggagccgtgagtatatgtgtataagctagtaacacgtgatggtcaagggaagtactaccatttcctgtgggttattagggcctccagctgttatgaggacacactggggaatctcagctttagggagtcgatgatgt

SEQ ID NO: 9340 - DNA, 5709 bp, Homo sapiens
cttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactattggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggattttagcatgaattccagctggggagtcttaacagatgccccttttactgatagagcacctaaagcgatctttggctccataggaccataggaagggtcagtacagaagaacctagatactgccctgcccctgagaactgtgtatatgtggggcctgtctgcagcacccatctcaggtgggttccagagggcctttagggtataatgagagcctgttaggtggaagaggcccagttccagaaatgttccagcccacccctgagaattcctcctgtttagttgtgtgggaagccctcgtcttccaggctgtccttgcgccttgaacctggagaagtgagctcactgttctcaatacttcacaaatgtaaaactttctttcgtctgcatgtgctcagccatctaaattgagcaaatgatctggtgagcactgggttagaatcaggaatggtggaatacaatctgaacctctcagagcccagaacagagggttcctgacactgtgacactgtctcctggaactaagtatctcttgaatcatgacttggttttagatcagtcaagagagacccaggttttgccaggaatcgaatccctaaataacatgtttttttctcacttagctcatgaatttgcatagtagacagtagttctgaattagattttgaaaacctaatttcagggctcattttttcctgtggccctaaatccattctatcaaattgtgtgatactgacatgcagtcatctgaggaactcagcgtagatacttgagcagctcctcgcctcttttctaactcaagtttgactaaaatacatacactccgtacagaaggtagggggttatgtaagaaaggaaaacctaatctatggaatcaggagttgtcaccaccgagcttcctctggaagtctgcccatcagcttgcttgttctctgttaagaggaagggctaggacaaggatttgggcttgaatatgtggaaaggaattttcatagttgttgctgcaggacctacaaaagtttaaaattagattggatgtgactcaatgacaagtcccatctgtgtaattgttaaggggacctgattgactcctgtggtttgattgagcaaccaggtaaatagagacctctctccagctttggcaaaacccatcagaggctgctgcagaactcagacagagggatctgcccttgggtttgcttccatcctgttccattgctaagcccttgtgacttggatcctaggactgaaaagtttttagctgcctcagctttcccctgaccttactggcagaggttctgcagatgtttcctttggaagatctcttgccaagaatagcattcctttggaggaggggggttctagttggaatgttgcttttcttggttagtgtaaatgtattgctagtgagacagctgccggcgctggaaaaggctcgtctcacagggagagtgctggtccccagaatgtgtgctgttcccacgctgctgcctttcttgagcttgttagaggaaagccagaaaggcattcagatgggatcagtctggctttcaaattttttttaattcctaagttctgttttattttttaattttttaaaaaaaattttattagagacagtctctctctcttgcctagctgggagtgcagtggagtgatcatagctcactgaggcttgaactcctgggctcgagcaatccacctcagcctccagagtaggggagactacagatgtgtgccaccatactcagctaatttttaaactttcgtagagacagggtctccctgtgttgcccaggctggcctcgaactcctgacctcaaaaaatcttcctgccttggcctcccaaagcactgggattataggtgtgagccattgcgcctggtcataaattcttgtttttttgtttgtttgtttattagagatggaatctctctctcttgaccaggctagagggctgtggtgcgatctcagcccactgcaacctctatctcctgagctcaagcgatcctccttagcttcccaaatagctggaactacaggcatgtgccatcacgtccagctaatttttgtatttttagtagagaaggttttaccatgttggacagggtggtctcgaactcctggcctaaagtggtccacctagctcagcctaccaaagtgctgtgattacaggcgtgagccaccatgcccagcctctaaattctgttttctattcaaagtaaaaatgacatgtgtttgagtcatccacttgctcatttgcatatggaatattgtatgtgaatattttattacacccttaaaattaattttcaagggctatatgtagagctcagaagaaacatctctgctgctgaaatcaaacctggtccaaaaaacgtcacaacggaggaaaggaatagatggctctcgaggacaagatagggactcttaaaacacctgcttggccatggttgattgacatttgagtgatctggtagcccaacacaccctgtgaagttcaggtgaactgaaatgggcaggtgtaggctacacaccagtctgaaccagcacaaccaagagttgtttctcttttttttctttttctttttcttttttttcttttttttttttttttttttgagatgaagtcttactctgttgcccaggctagagtacagaggcacaatctcggctcaccacagcctccgcctcctgggttcaagcaattctcctgcctcagcctcccaagtagctgggactacaggcatgcaccaccatgcctggctaatttttgtatttttagtagagatggggtttcaccatgttggccaggctggtttcgaactcgtgacctcaggtgatccacccacactttgggcggccagaggcaggcagattgcttgagcccagaagtttaagaccagcctaggaaacagaccccatctctacaaaaaattcaaaaagccgggcgtgaagccctgttttttttttaaaaaaagagtctgctggtgatgtctgggcatgtgtctgcttcacagtccagtgttatgatcagtagctgtgatggacaatgaacattgctgcttgttcaaaatgaagaaaaaaaatatcaaagaaaaccaggtttggaagtttcagatttggaaaaggagctgggccagcccatctggaatagctgaggggccctgttagccccaccctaccccaccccacccccgtatgcagcatctctggcggtgcccagagagggcaccgtggggtgttcaggcttctgtgaggccccagtgagatcctgtggctgtgcccccatcacctccacccactctgccctcccactagctgcccaacggatgaatcaacgccttggcagagttttccagcagggccttgcagagagtgtgtgtgacctgtgtggccactgccttggggacgggtgaggagttagcctggaacattccagcgtgggcattattgtcctgttgcaagttcagggcaaaaccaggaatccagttttgtcgatccaattgagaaaacatttcatgaacaactacttgtggcatgcattggcactcggaataaagcgcactattgtcactaggttggcatttc

SEQ ID NO: 9341 - DNA, 5108 bp, Homo sapiens
cttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactattggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggattttagcatgaattccagctggggagtcttaacagatgccccttttactgatagagcacctaaagcgatctttggctccataggaccataggaagggtcagtacagaagaacctagatactgccctgcccctgagaactgtgtatatgtggggcctgtctgcagcacccatctcaggtgggttccagagggcctttagggtataatgagagcctgttaggtggaagaggcccagttccagaaatgttccagcccacccctgagaattcctcctgtttagttgtgtgggaagccctcgtcttccaggctgtccttgcgccttgaacctggagaagtgagctcactgttctcaatacttcacaaatgtaaaactttctttcgtctgcatgtgctcagccatctaaattgagcaaatgatctggtgagcactgggttagaatcaggaatggtggaatacaatctgaacctctcagagcccagaacagagggttcctgacactgtgacactgtctcctggaactaagtatctcttgaatcatgacttggttttagatcagtcaagagagacccaggttttgccaggaatcgaatccctaaataacatgtttttttctcacttagctcatgaatttgcatagtagacagtagttctgaattagattttgaaaacctaatttcagggctcattttttcctgtggccctaaatccattctatcaaattgtgtgatactgacatgcagtcatctgaggaactcagcgtagatacttgagcagctcctcgcctcttttctaactcaagtttgactaaaatacatacactccgtacagaaggtagggggttatgtaagaaaggaaaacctaatctatggaatcaggagttgtcaccaccgagcttcctctggaagtctgcccatcagcttgcttgttctctgttaagaggaagggctaggacaaggatttgggcttgaatatgtggaaaggaattttcatagttgttgctgcaggacctacaaaagtttaaaattagattggatgtgactcaatgacaagtcccatctgtgtaattgttaaggggacctgattgactcctgtggtttgattgagcaaccaggtaaatagagacctctctccagctttggcaaaacccatcagaggctgctgcagaactcagacagagggatctgcccttgggtttgcttccatcctgttccattgctaagcccttgtgacttggatcctaggactgaaaagtttttagctgcctcagctttcccctgaccttactggcagaggttctgcagatgtttcctttggaagatctcttgccaagaatagcattcctttggaggaggggggttctagttggaatgttgcttttcttggttagtgtaaatgtattgctagtgagacagctgccggcgctggaaaaggctcgtctcacagggagagtgctggtccccagaatgtgtgctgttcccacgctgctgcctttcttgagcttgttagaggaaagccagaaaggcattcagatgggatcagtctggctttcaaattttttttaattcctaagttctgttttattttttaattttttaaaaaaaattttattagagacagtctctctctcttgcctagctgggagtgcagtggagtgatcatagctcactgaggcttgaactcctgggctcgagcaatccacctcagcctccagagtaggggagactacagatgtgtgccaccatactcagctaatttttaaactttcgtagagacagggtctccctgtgttgcccaggctggcctcgaactcctgacctcaaaaaatcttcctgccttggcctcccaaagcactgggattataggtgtgagccattgcgcctggtcataaattcttgtttttttgtttgtttgtttattagagatggaatctctctctcttgaccaggctagagggctgtggtgcgatctcagcccactgcaacctctatctcctgagctcaagcgatcctccttagcttcccaaatagctggaactacaggcatgtgccatcacgtccagctaatttttgtatttttagtagagaaggttttaccatgttggacagggtggtctcgaactcctggcctaaagtggtccacctagctcagcctaccaaagtgctgtgattacaggcgtgagccaccatgcccagcctctaaattctgttttctattcaaagtaaaaatgacatgtgtttgagtcatccacttgctcatttgcatatggaatattgtatgtgaatattttattacacccttaaaattaattttcaagggctatatgtagagctcagaagaaacatctctgctgctgaaatcaaacctggtccaaaaaacgtcacaacggaggaaaggaatagatggctctcgaggacaagatagggactcttaaaacacctgcttggccatggttgattgacatttgagtgatctggtagcccaacacaccctgtgaagttcaggtgaactgaaatgggcaggtgtaggctacacaccagtctgaaccagcacaaccaagagttgtttctcttttttttctttttctttttcttttttttcttttttttttttttttttttgagatgaagtcttactctgttgcccaggctagagtacagaggcacaatctcggctcaccacagcctccgcctcctgggttcaagcaattctcctgcctcagcctcccaagtagctgggactacaggcatgcaccaccatgcctggctaatttttgtatttttagtagagatggggtttcaccatgttggccaggctggtttcgaactcgtgacctcaggtgatccacccaccttggtctcccaaagcgctgggattacaggcgtgagccactgcacttggccaggagctgtttaagccatcaggagacatgctgacccactagaagaggctgctacgctcatttcttccacaaacgtttactgggcacc

SEQ ID NO: 9342 - DNA, 888 bp, Homo sapiens
caggggttttaggtcaggaaatggtaggaaacctgtagttgtggctcataatcctagtgggatattagaaccctcttcatttgtcagaacagattcctggggtctgctcccaattattcacacggtggttcatgcctggtaatcccagcactttgggcggccagaggcaggcagattgcttgagcccagaagtttaagaccagcctaggaaacagaccccatctctacaaaaaattcaaaaagccgggcgtgaagccctgttttttttttaaaaaaagagtctgctggtgatgtctgggcatgtgtctgcttcacagtccagtgttatgatcagtagctgtgatggacaatgaacattgctgcttgttcaaaatgaagaaaaaaaatatcaaagaaaaccaggtttggaagtttcagatttggaaaaggagctgggccagcccatctggaatagctgaggggccctgttagccccaccctaccccaccccacccccgtatgcagcatctctggcggtgcccagagagggcaccgtggggtgttcaggcttctgtgaggccccagtgagatcctgtggctgtgcccccatcacctccacccactctgccctcccactagctgcccaacggatgaatcaacgccttggcagagttttccagcagggccttgcagagagtgtgtgtgacctgtgtggccactgccttggggacgggtgaggagttagcctggaacattccagcgtgggcattattgtcctgttgcaagttcagggcaaaaccaggaatccagttttgtcgatccaattgagaaaacatttcatgaacaactacttgtggcatgcattggcactcggaataaagcgcactattgtcactaggttggcatttc

SEQ ID NO: 9343 - DNA, 331 bp, Homo sapiens
aagaaaaaaaatatcaaagaaaaccaggtttggaagtttcagatttggaaaaggagctgggccagcccatctggaatagctgaggggccctgttagccccaccctaccccaccccacccccgtatgcagcatctctggcggtgcccagaggcaagcccccttcagtttcccacctctcactctgccttccagagcctagtcaagttttaaattcccaggtccactcagcagaacttgctcccttctctgactgcagtctcataatgaaaggagaggtgctttcagttgggtcatttggtagcgtttaggcttagaagttactaatttggag

SEQ ID NO: 9344 - DNA, 5638 bp, Homo sapiens
cttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactattggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggattttagcatgaattccagctggggagtcttaacagatgccccttttactgatagagcacctaaagcgatctttggctccataggaccataggaagggtcagtacagaagaacctagatactgccctgcccctgagaactgtgtatatgtggggcctgtctgcagcacccatctcaggtgggttccagagggcctttagggtataatgagagcctgttaggtggaagaggcccagttccagaaatgttccagcccacccctgagaattcctcctgtttagttgtgtgggaagccctcgtcttccaggctgtccttgcgccttgaacctggagaagtgagctcactgttctcaatacttcacaaatgtaaaactttctttcgtctgcatgtgctcagccatctaaattgagcaaatgatctggtgagcactgggttagaatcaggaatggtggaatacaatctgaacctctcagagcccagaacagagggttcctgacactgtgacactgtctcctggaactaagtatctcttgaatcatgacttggttttagatcagtcaagagagacccaggttttgccaggaatcgaatccctaaataacatgtttttttctcacttagctcatgaatttgcatagtagacagtagttctgaattagattttgaaaacctaatttcagggctcattttttcctgtggccctaaatccattctatcaaattgtgtgatactgacatgcagtcatctgaggaactcagcgtagatacttgagcagctcctcgcctcttttctaactcaagtttgactaaaatacatacactccgtacagaaggtagggggttatgtaagaaaggaaaacctaatctatggaatcaggagttgtcaccaccgagcttcctctggaagtctgcccatcagcttgcttgttctctgttaagaggaagggctaggacaaggatttgggcttgaatatgtggaaaggaattttcatagttgttgctgcaggacctacaaaagtttaaaattagattggatgtgactcaatgacaagtcccatctgtgtaattgttaaggggacctgattgactcctgtggtttgattgagcaaccaggtaaatagagacctctctccagctttggcaaaacccatcagaggctgctgcagaactcagacagagggatctgcccttgggtttgcttccatcctgttccattgctaagcccttgtgacttggatcctaggactgaaaagtttttagctgcctcagctttcccctgaccttactggcagaggttctgcagatgtttcctttggaagatctcttgccaagaatagcattcctttggaggaggggggttctagttggaatgttgcttttcttggttagtgtaaatgtattgctagtgagacagctgccggcgctggaaaaggctcgtctcacagggagagtgctggtccccagaatgtgtgctgttcccacgctgctgcctttcttgagcttgttagaggaaagccagaaaggcattcagatgggatcagtctggctttcaaattttttttaattcctaagttctgttttattttttaattttttaaaaaaaattttattagagacagtctctctctcttgcctagctgggagtgcagtggagtgatcatagctcactgaggcttgaactcctgggctcgagcaatccacctcagcctccagagtaggggagactacagatgtgtgccaccatactcagctaatttttaaactttcgtagagacagggtctccctgtgttgcccaggctggcctcgaactcctgacctcaaaaaatcttcctgccttggcctcccaaagcactgggattataggtgtgagccattgcgcctggtcataaattcttgtttttttgtttgtttgtttattagagatggaatctctctctcttgaccaggctagagggctgtggtgcgatctcagcccactgcaacctctatctcctgagctcaagcgatcctccttagcttcccaaatagctggaactacaggcatgtgccatcacgtccagctaatttttgtatttttagtagagaaggttttaccatgttggacagggtggtctcgaactcctggcctaaagtggtccacctagctcagcctaccaaagtgctgtgattacaggcgtgagccaccatgcccagcctctaaattctgttttctattcaaagtaaaaatgacatgtgtttgagtcatccacttgctcatttgcatatggaatattgtatgtgaatattttattacacccttaaaattaattttcaagggctatatgtagagctcagaagaaacatctctgctgctgaaatcaaacctggtccaaaaaacgtcacaacggaggaaaggaatagatggctctcgaggacaagatagggactcttaaaacacctgcttggccatggttgattgacatttgagtgatctggtagcccaacacaccctgtgaagttcaggtgaactgaaatgggcaggtgtaggctacacaccagtctgaaccagcacaaccaagagttgtttctcttttttttctttttctttttcttttttttcttttttttttttttttttttgagatgaagtcttactctgttgcccaggctagagtacagaggcacaatctcggctcaccacagcctccgcctcctgggttcaagcaattctcctgcctcagcctttgagaggctgaggcaggaggatcccttgagcccaggagtttgagaccagcctgggcaacatgacaaaaccccatctctccaaaaatacaaaaattagccaggcatggtggtgcacacttgtagtcccagtaattagggggctgagacaggaggatcacttcagcctatgagtttgaggctgcagtgagctgtgattgcgccactacactccagcctggatgacaggacgaaacctgtctcaaaaacaccaaaaaacaaaaaccggtctcctggggtcatggtagcacaaacgcacatgactgagtgctcaggggttctgaggcttgtccgctgacctggggctctggccctgggagatctgggggacctgctgtcctatatgtgatgctttgaaagaaaggggcatcattccaagccaagaggccccagagagggcaccgtggggtgttcaggcttctgtgaggccccagtgagatcctgtggctgtgcccccatcacctccacccactctgccctcccactagctgcccaacggatgaatcaacgccttggcagagttttccagcagggccttgcagagagtgtgtgtgacctgtgtggccactgccttggggacgggtgaggagttagcctggaacattccagcgtgggcattattgtcctgttgcaagttcagggcaaaaccaggaatccagttttgtcgatccaattgagaaaacatttcatgaacaactacttgtggcatgcattggcactcggaataaagcgcactattgtcactaggttggcatttc

SEQ ID NO: 9345 - DNA, 5413 bp, Homo sapiens
cttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactattggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggattttagcatgaattccagctggggagtcttaacagatgccccttttactgatagagcacctaaagcgatctttggctccataggaccataggaagggtcagtacagaagaacctagatactgccctgcccctgagaactgtgtatatgtggggcctgtctgcagcacccatctcaggtgggttccagagggcctttagggtataatgagagcctgttaggtggaagaggcccagttccagaaatgttccagcccacccctgagaattcctcctgtttagttgtgtgggaagccctcgtcttccaggctgtccttgcgccttgaacctggagaagtgagctcactgttctcaatacttcacaaatgtaaaactttctttcgtctgcatgtgctcagccatctaaattgagcaaatgatctggtgagcactgggttagaatcaggaatggtggaatacaatctgaacctctcagagcccagaacagagggttcctgacactgtgacactgtctcctggaactaagtatctcttgaatcatgacttggttttagatcagtcaagagagacccaggttttgccaggaatcgaatccctaaataacatgtttttttctcacttagctcatgaatttgcatagtagacagtagttctgaattagattttgaaaacctaatttcagggctcattttttcctgtggccctaaatccattctatcaaattgtgtgatactgacatgcagtcatctgaggaactcagcgtagatacttgagcagctcctcgcctcttttctaactcaagtttgactaaaatacatacactccgtacagaaggtagggggttatgtaagaaaggaaaacctaatctatggaatcaggagttgtcaccaccgagcttcctctggaagtctgcccatcagcttgcttgttctctgttaagaggaagggctaggacaaggatttgggcttgaatatgtggaaaggaattttcatagttgttgctgcaggacctacaaaagtttaaaattagattggatgtgactcaatgacaagtcccatctgtgtaattgttaaggggacctgattgactcctgtggtttgattgagcaaccaggtaaatagagacctctctccagctttggcaaaacccatcagaggctgctgcagaactcagacagagggatctgcccttgggtttgcttccatcctgttccattgctaagcccttgtgacttggatcctaggactgaaaagtttttagctgcctcagctttcccctgaccttactggcagaggttctgcagatgtttcctttggaagatctcttgccaagaatagcattcctttggaggaggggggttctagttggaatgttgcttttcttggttagtgtaaatgtattgctagtgagacagctgccggcgctggaaaaggctcgtctcacagggagagtgctggtccccagaatgtgtgctgttcccacgctgctgcctttcttgagcttgttagaggaaagccagaaaggcattcagatgggatcagtctggctttcaaattttttttaattcctaagttctgttttattttttaattttttaaaaaaaattttattagagacagtctctctctcttgcctagctgggagtgcagtggagtgatcatagctcactgaggcttgaactcctgggctcgagcaatccacctcagcctccagagtaggggagactacagatgtgtgccaccatactcagctaatttttaaactttcgtagagacagggtctccctgtgttgcccaggctggcctcgaactcctgacctcaaaaaatcttcctgccttggcctcccaaagcactgggattataggtgtgagccattgcgcctggtcataaattcttgtttttttgtttgtttgtttattagagatggaatctctctctcttgaccaggctagagggctgtggtgcgatctcagcccactgcaacctctatctcctgagctcaagcgatcctccttagcttcccaaatagctggaactacaggcatgtgccatcacgtccagctaatttttgtatttttagtagagaaggttttaccatgttggacagggtggtctcgaactcctggcctaaagtggtccacctagctcagcctaccaaagtgctgtgattacaggcgtgagccaccatgcccagcctctaaattctgttttctattcaaagtaaaaatgacatgtgtttgagtcatccacttgctcatttgcatatggaatattgtatgtgaatattttattacacccttaaaattaattttcaagggctatatgtagagctcagaagaaacatctctgctgctgaaatcaaacctggtccaaaaaacgtcacaacggaggaaaggaatagatggctctcgaggacaagatagggactcttaaaacacctgcttggccatggttgattgacatttgagtgatctggtagcccaacacaccctgtgaagttcaggtgaactgaaatgggcaggtgtaggctacacaccagtctgaaccagcacaaccaagagttgtttctcttttttttctttttctttttcttttttttcttttttttttttttttttttgagatgaagtcttactctgttgcccaggctagagtacagaggcacaatctcggctcaccacagcctccgcctcctgggttcaagcaattctcctgcctcagcctcccaagtagctgggactacaggcatgcaccaccatgcctggctaatttttgtatttttagtagagatggggtttcaccatgttggccaggctggtttcgaactcgtgacctcaggtgatccacccacactttgggcggccagaggcaggcagattgcttgagcccagaagtttaagaccagcctaggaaacagaccccatctctacaaaaaattcaaaaagccgggcgtgaagccctgttttttttttaaaaaaagagtctgctggtgatgtctgggcatgtgtctgcttcacagtccagtgttatgatcagtagctgtgatggacaatgaacattgctgcttgttcaaaatgaagaaaaaaaatatcaaagaaaaccaggtttggaagtttcagatttggaaaaggagggaacattccagcgtgggcattattgtcctgttgcaagttcagggcaaaaccaggaatccagttttgtcgatccaattgagaaaacatttcatgaacaactacttgtggcatgcattggcactcggaataaagcgcactattgtcactaggttggcatttc

SEQ ID NO: 9346 - DNA, 302 bp, Homo sapiens
tggaaattaaacaacaaactcataaataatgaatggttaaagaaaatcacaagggaaattagaaaatatttggaatgaattaaagtgaagacataacaccaaaacttacgggaagcaataaatgcagagcttagaaggaaatttatattaataagagatctcagtcacaatgtcttgtgcctataatcccagggacttgcaaggctgaggcaggaggatcacttgagcccaggagttggaagctgccatgagctgtggtcacaccattgcactccagtctgggccatagagtgagactaaaa

SEQ ID NO: 9347 - DNA, 365 bp, Homo sapiens
ccttgagatctacacccacttaacttccacctccagatcgtctccatgtggaaactgcagaaagcttttgctgactcctcagcggggcccgtgggacctgtggaatcattctgtggaatgaggcagagggtcccctccccaacgcccacagggcagctactgcctgttgccatggagatgctggatagctttaaacagaccctacctgctacccacttctggggcggctgccttgcaagatgaaagggcctggctagaactcagaaggtctgctgtcctcttaggcccttgggttgatcgcctcatggaggctgttttgatcatcatcatcaatgcaaataattaaaatttttaaaaacaatttt

SEQ ID NO: 9348 - DNA, 1197 bp, Homo sapiens
ttaggcctccacgtcctcgctggagctgcggacctcagtcgtccatccacacctcccccctgccgcccccgcccatctcactctcccaaccctgggcaccagggcaggtcgacagcccgaggcactcctctactgcgtttccaggcccaggagacccactccagcgccgcggttccttgcgacccggcagccgttcagcagacctcccattctttcctgcatcatcgggcattgtggaggcaccctacggtgattcctctcagagcctgtttgtaggtgaccgtgacagagacaaaaccatggaagtgactgggtttggagtgaccaggtgttcctccctcccctttcccagacacgcctcttgctgtaggtctctggttaagtctctctctctcattcccttcctgggagacagtagctccctaggcctgcaatgagggaggctggcttggggaaggagacgggaattgggcgtctttgaagacctgtgggcagagggagggagggagggtgtttgtcctgggtggggctctgggccaggtcctctgggtagctgtgaagtggtgaaagaaggggtgggaacgctggacttctggactttgggcagggcagatcctctgactctctggctgcagaacagtttcttccgtgctctggcctgagtgccacagccagggcctctgctctgtacacaggtaagaaggcttcaaagatgagaaacaagacccctctgaggaagtgggaacacagtctgagtcctggggggtgggaagtatgggttgaaggttagtgggaaaatatgcagggctgaccaggtttggagatgctgggcttagttctgcaggtgatgcagcctgaagaccttgagctttctgggaccctgtaatgtggatcctgcaaggaaggctcttgttttcttcttttccctttcttccctgatttaactttgcagagattccttccgttttttctagacccctgcattattttctgcatatctcccactttaaccctgtgccatttgcagctctcccacagaccttctgtgatccccatagtgctgtctctcatcccttgattccttttcctaactcaggctgtaactgcttttttgttcttttcctaagtcctaaatccttctgctagttctaagcacctttgttcctactatagtcttcctttatttaagtcagttca

SEQ ID NO: 9349 - DNA, 441 bp, Homo sapiens
tcatatatttataaaatgtgtttttactgttttttatttttaacggcaagtgaaaggatttttattttactaatgtttcttaacctatatttggctgataactgcttctaatttttaaatacattttcttttttgaacttgttatggaaatttttagtcacaaatatagactagcacagtggactccctgaaccaccactcaaacttagcaaacgtcagctttattgctgctcttgtttgatctattgcctcgtccccgccaatatttttttctttgaccatttaaagcaaatcctaaccatcgtatttcacccaacagaattaatatccttaatatctaatatgtagtctgctcagttttcccatgttgtctcaaaaatgtattttgactgtttatttgttcaaattaagatctaaataagagccacactgtgcatttga

SEQ ID NO: 9350 - DNA, 330 bp, Homo sapiens
gtgcctgtagtgccatctactaaggaggatgaggcaggaggatcactggagtccaggagtttgataccatactggacaatatggtgagaccccgtctcaaaataataataataattttttgtgcttaaatcatatatttgccatataaattaaaattacctgaaaatatgtaagacaggttgattgggaagaacaaactttgtctttatattccacaaatactatctaagctctattaatgtatttctaattttaaatattttattttaaataactatcactaaaaaatgtcaaaattattctaaaattccttagggtatttgagaggct

SEQ ID NO: 9351 - DNA, 939 bp, Homo sapiens
gaactaaaaaatatttaccataagtccaagttatgacttgaggatcatatctgattagaactgtggcagaactactagaaaaagattctgcaaattggtttcagtgattcttgttgatgtaatcaacaagattacataatcaacaataatagatattgaaccaaaatgatcctttttttaagtttaaggttatttagtttctcttgcaaggatatgatttagtcacacactaatagggaatatgtgtatgtactggtggggagcagtgggcttgctgcatgtatgtatgttttaaaattaataaatattatcttactgggctccatagatggtttaaatttagatttatttaattaagaggctataaataatatatacactactgtatggtatttaacaaataagttttaaatctgttaattcttctggaaaactttggatgtagggatggcaagctaattttcttgtatagctggtgatataagcagcatggtgataaaataacatttcttataaagactaactggtaatagttgtgacagaacctggttttcctgactgagaatcccttgcttgcttagaatatctgacttcccattgaaatggaacatagaaaatgtgttttcttatgtgactctcattattggttcctttatcttagttgtgctacaatataaggctggacctgtaatacactatgtatcagactagactgaaaaatgtgatcgatttgttttctaagtcctcctctatataactgaaccatggtcaggggattagagaagcaacagagcactgctcctaaggctttaggctagtcttagtgaattggactgaatggatttttctctgttgttttttgcattaagtgtttttgcactagaagagggtgcttaacactcctctatctatatgaataaaaaattatgttctcacaaa

SEQ ID NO: 9352 - DNA, 379 bp, Homo sapiens
gaacaccattcagcccatgacagagagaaaaccacagaaattcaccttcggaaacattttctgaaaactaaagcttacggttagggtatcagtgcccttttcccagaaacattatctctacctcaataagggccagaaaattcataaatcccaccttcatccctgtagcatcactgctagaaaaccatcacgtctccagggtgagaaatacttttggaattgaactaacctctgattaggttccccttgatgtctttgccacgtggtgccctctaacagggtggttagaaggtaagtagttttatttcattccaccttttgatttctcccttcctggccctttggaaggtgcccatttctcattaaagatggagagaac

SEQ ID NO: 9353 - DNA, 5764 bp, Homo sapiens
ttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagttactctccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaa

SEQ ID NO: 9354 - DNA, 5581 bp, Homo sapiens
caaataaacgatgtgctggcctagttacctcgatgagaggtcaggaccttcaactgtagacgttctagaaagtatagatcaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagttactctccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaa

SEQ ID NO: 9355 - DNA, 5366 bp, Homo sapiens
atgatttctgcgagagtgaacagacagtcccattttatcgcgtgtaaccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagttactctccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaa

SEQ ID NO: 9356 - DNA, 4959 bp, Homo sapiens
aaaatttctaacaagtataggtagttcttggtaatggaattaaattttatgtgtatttcatgtatataaattttgtatgtatttatttatttaataggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagttactctccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaa

SEQ ID NO: 9357 - DNA, 5320 bp, Homo sapiens
caggtttcttcctatataatgtacagcccctaggccagttgttctcaaaccccactgtgcatcacaatcacccaaagagcttaaaataattatgatacccaggacccatttacaaagagtctcctttaatggactgagtatgaggtccaggcatcagtatattttttaaagctctgcagatgattctcatgtgtagccactattaaaaactactgtggtaaattgaaaatgcttctgaaatattatgtactacattttcatgggtaaatgtgcaagcttctggattttaaaatacctaatgattctggttactagaaatgtaatctcactaattcatttaaatcattaatattattctgctgtcaacctgctgtgtaacttattacatagttagcctgctatgtaacctgttatgccttttctgcctttaattttaaaaattaaaattctaataattaggaagtatgctttagttctgtttagagcatctaccatattattatttaaataacatacacagtaacttttaaaaggttcttttgaatatctgcaaaagtgatcttgtgagttaactaattagttcttgaactttgcttggtttgtggttttgcttatttttaaaaaattctctgcagcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagttactctccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaa

SEQ ID NO: 9358 - DNA, 2276 bp, Homo sapiens
ttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtga

SEQ ID NO: 9359 - DNA, 5534 bp, Homo sapiens
ttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagttactctccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaa

SEQ ID NO: 9360 - DNA, 3693 bp, Homo sapiens
ttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtcttcatcctccaggtccacctttagcaagacctattctcccccgagaacgaggtgctttggatagaattgttgaatatttggttggtgatggtccacaaaacaggtatgcacttatatgtcagcagtgtttttctcataatggcatggctttgaaggaagaatttgaatacattgcttttcgatgtgcctactgttttttcttgaaccctgcaagaaaaaccagacctcaggctccaagacttcctgagtttagttttgagaagaggcaggtggtggaaggttcaagttcagttggtcccttgccatcaggaagtgtgctttcatcagacaaccagtttaatgaagaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaactta

SEQ ID NO: 9361 - DNA, 4565 bp, Homo sapiens
ggggggggggggagggtcaaccaaacccctccctatcgcccccatcccctgaatctttagaacacgatgttcttgatgataatacagagcagacagatgacaaaataccagctacagaacagacaaaccaagtgattgaaaaagcatctgactcagaggaaccagaggagaaacaagagactgagaatgaggaagcctcagtgattgaaaccaactccacagttcctggagctgattctattcctgatcctgaactaagtggagaatctttgacggcagagtagtaaatgcttccacgtgccttcaactggatatttatagtcttactgatgtcagttattgctttttcggtggcacttactttttttgcccctctaagggtatgcttgtgtatcatttgaattcagattgcctagctatttgaacatctcaaagttatatatactgggtattaaaattaaaagcaagttatatcagtgaagtaagatccttttgaatgtacaaagacccacactattgagacagcttttagatacttttttgtccattctaaaagtaagcaaacatgattgccttcttgttttctgtatgtataacccgtaaatatccattttgacataggaagaactttggttaagagtaagttctctaattgtgtttgttttaaggaatgaaacttggttaagattttgactacttcattattaaaaattgatagaattttagctcctgagatatttacaactgggagaaatgtctatttaggtgtttacattaagcggtatgaaagttgttaccacataggcactggtacgaattctcaataagaatgcagtggaacagttaagtagaactgtaactacgttggcactggtacgaattctcagtgagaatgcaatgaaacagtcaactgcagtgtttctttttgatgtcttttattttacaactgggccaaaggcacattatgtatataattagtttatatttacacactagcatataggaaatatttctgcacttgaccctatttgaattctgagcattatttataagtataaaatgatgatatataagtgaattttgtgctcttgtttgtattttattaaggaaaatgaaaataatctggcatcagtttcattttgctaaatatctagtcttcttcaaacagtatcttggtgggtgacttggctacctgaaaaatcttaggaggaatagctcacaatacaataaatctgtagattctgcttagagcaaattatggtacttttattcagacttgtttcctttctagttaacagaaatagtgacatttagaggttttaatcagaagttaggtttttctgattcaggaacatcgtaggccagccatttgtaatttttaactttgagaaacaaattttgtgagaataggtagtgggttgctggtagttaattggatttaatatttgtattaaggattaactggaaaaaatgtgtctcagtgctaattcttggacctttaatacagtgtgcttatctgttacggcctccttttatctctcttctccaatattaaaaaaaatggaaatcaaattattatgctgaagggaaaaatatacctgtataagaatggtgtgtttggctaatgtttctaagttgcacacagtttattaacaactgaacaaaacatttttatcatttaaaaatctatttttatgatttaatatctcatatgtgacagtttttttttttttttttttttggaactcaatctgttaacagtctgggacatccggtatagtaaccagagtttttgagcctgccgtattgggcttaaatttcaggtctgtagtcttgggcaagtcacctataaactcactgagattattttttcatctgtaaaatgggaagagttatgtttatttttgaagggtattaggataattaaaaataatgtaatgtgcctagcacactacctgaaaacgatggcatttgttcttattaatgtctttaaaatatgcaaggaccataagtttttcctcttgcagatgaggaaagtaaaaaataatacgaacatgtaattcagcttctcagattcaagccaatgttttttgcatcaacttttctatattgtatgtatgtatataaatacatagattaaggaaataggaaactgaaactctgtggaatataaactttttaaaaataatttcatcaggttttttgtatgttactgacccatatggattttagtaacatcttgcttagtcatgttgttataaaacattcaaattctgatatacattgcttgaaaatgagtgagtacctcagagaaatttgatagactcaaacagatagtatgagaaatatctttgaaagaaatatggaggaaggttaaaaggggattagtaaaattaatgcgataggtaacatgtttgtaaccatatagtatccttttagatacaaaagcttattttcattattattataataaacagttaatggttgaaacttagtaaaatgtcctatttctgattattaagactagtataaatgagaaaatccaagctattaagtaccattagctacagtgatcttagcttccttgcttacaattgttcagtgggtcatctaaattcttctatgtcctgagcatgatctacaaacatggtctagcttctgtctctccgtcttcccgccatcattgtgctgtagccatatggaactcctttcagttctctgaccatgccctttcctgcctcagatttcagcttaaattttgcctcctcagagagatgccttcccaaactccccatctgaagctggcctctgccttttactccctatcatgtcactctctgctcaccatccttatcacaatgtgtatttgatttgtttgctagtttactgtcttcacaacataatgtccgtttgtgcaagggtcttatttttcttattcatgtctgtatctcaagggtctagcacaatgcttgatgcatattgtgtgaataaatactttgttgccaaatccagtgaaaactctcagttcttgtttcactgcttggcagtattgacattgaatattctctgagatactttttttcttttggcttttcatatatcacactattattctcttatttctctggcctcttgctctcaacgtcctgtaagtgttggtgttccttaagttctacctagtgtcatcatttcttcattctgcatattctttccctagggtttcttcccaacaccaaaggacttaccatctgtctctctgaatctcagatctccagctttgatctgtttcctttactttagagctatatatttgcctgcctactggcctgtctctcacaatccatatattcaagaatgaacactatactttgcttcaaaccttcagaacattcaaaccgtttatgtttctcatctaatcaaatagagttactctctaagccagaagttactctccctttattcaagctgtcaatttttgtctcctaaacatcttctagttatattctcatttctctgttcacattgcattaataatgatgataaacatttgcattcttattctgtgccaggcaacatgctaactgctgtatatatattattatatttgtactttggcaagaatcctgtgaagatttttatctttggactactagaagagaaagctgagttgtagagagagtatgtatttaagtccgtttgggctgctataacagaataccacagactgggtaacgtgatgaacaaaaatttatttggctcacagttctggaacctgggaaatccaaaggcatgatgctagcatctggtgagggcctttgtgctttgtcatcccatgccagaaggcagaagggtaagagagggcaagagtgagcaagagatggaagttgcaacctcaagctcttttataatgagcattaatccattcatgagggcttcaccctcatgacctaaacatctccattaggctccaccttccaatgcaacagttagcataagttttcaacacatgctttttgtagcattcaaaccatagcaggaagcaactttgcttaaaattgtatacctggtaagtggaaaaagagggatttgaatataggcaaatgacttcagaggatttactcttaatttctgttgtactgccttctaatcttggcctccatcatttcagattaccaaagctgtctcttaactggtttctttgtctccaaccttgtgcacttgctatctattctgtgtgctgcagcctgagtttttaaaaaacagaaaatgaggggccaggtgtggtggtggctcacgcctgtaatcccagcaagttgggaggctgaggcgggcagatcatctggggtcaggagttcgagaccagcctgaccaacgtggagaaacactatctctactaaaaatacaaaattagccaggcgtggtggtgcatgcctgtaatcctagctactcaggagcctgaggcaggagaattgcttgaacacgggaggcagaggttgcagtgagcagagattgcgccattgtactccagcctgggcaacaagagtgaaactccatctcaaaaaaaa

SEQ ID NO: 9362 - DNA, 1127 bp, Homo sapiens
ttcatgggaaggagttggcccggcttgtctctctgtcagtggcggctgctgcctgctctggaggcaggctgggcggtggcggccgagactggcgggggtggacgcccgggccgggctgcgcccgcttcttgcagctgtgaattcctttggacaattgatgatatttatcattgtgcccagtttctacaaataaaagatgggtggattattttctcgatggaggacaaaaccttcaactgtagaagttctagaaagtatagataaggaaattcaagcattggaagaatttagggaaaaaaatcagagattacaaaaattatgggttggaagattaattctgtattcctcagttctctatctgtttacatgcttaattgtatatttgtggtatcttcctgatgaatttacagcaagacttgccatgacactcccattttttgcttttccattgatcatctggagcataagaacagtaattattttcttcttttccaagagaacagaaagaaataatgaagcattggatgatttaaaatcccagaggaaaaaaatacttgaagaagtcatggaaaaagaaacttacaagacggctaaattaattcttgaaaggtttgatccggactcaaagaaagcaaaggagtgtgagccgccatctgctggagcagctgtaactgcaagacctggacaagagattcgtcagcgaactgcagctcaaagaaacctttctccaacaccagcaagccctaaccagggccctcctccacaagttccagtatctcctggaccaccaaaggacagttctgcccctggtggacccccagaaaggactgttactccagccctatcatcaaatgtgttaccaagacatcttggatcccctgctacttcagtgcctggaatgggtaaacagagcacttaatgttatttacagtttatattgttttctctggttaccaataaaacgggccattttcaggtggtatggaaatggcatttcatttggaaatagcagagcagttatctgattaagcaggagttccatattcaattagccataactctttacagctggcaccttgtgatactgaaacctatttcttgagctcatttaactgttatggcttctt

SEQ ID NO: 9363 - DNA, 833 bp, Homo sapiens
cagcttttactgtgtgcgaggcactattggagaaagcaaaacagaaatccagaaactttaagtagccaattgttatgttagtttcctttagttgtatgaaacaaaggttctctcggtgcagcgtctttaaaaaaggaagatttattgttgtgctctgtgtggtgtagaactagcgtgccagaaaatctgaagccacttagtggctggttcctctctcggtagtagtgactgctctgagtgcctgttgtgtcttccttttgctaactaaaggcattctgttcacacttctttagtttaaatcctacagaagtctgtctgattttttttcagaattaattctattgagctgtagtttgcatacaataaaatacaactattttaagtttgatgactttggcaaatttaggtacccatgtaaccatcaccattaaagatacagaacatttccatcaccccagagagtttccttttgcccctttgcattcacccccactccctgcccccagccagcctcagctccaaggaaaccattaatctgctttctgtacttgtagattagagttgccttttctataatttcatataaatggaatgatagaatatatagtcttttgtgttggtcttttgttttaaaacttatcctgatatttcatgtattattcctttttattgctgactatagtattctatgaaatacatttcatagaatatgtttatctgtttcattcaatttcatagaaattgtttatctgttcactagttgatggacaattgagttgttttcagtttgggatattatgaataaaattctgtgaccactcatgtacaagtct

SEQ ID NO: 9364 - DNA, 1051 bp, Homo sapiens
gggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacattaaaaagatgtctataaacagcta

SEQ ID NO: 9365 - DNA, 347 bp, Homo sapiens
tgagtcagaacagggactactgggactgtgtcatcctggaatccagtcttttcctctcctttacaccaggaatagaatagatttcctggcatcagatgccagagagacgcatttactgttcactgtgtgtaagttatcagaatcagaagtactactaacaactctcagcaaaaaggcattgggacaaaggcaatgaggaacagttgtttctgaggtagcttcactttatgagaatgagcagcaagggaaatttatggtgaaggaaacagtttctatgttttttgtataattaatagcttcttcaagatgtcacagcatctgggtggcttttgagaggagcacaccat

SEQ ID NO: 9366 - DNA, 914 bp, Homo sapiens
  misc_feature (24)..(24): n is a, c, g, or t
  misc_feature (204)..(204): n is a, c, g, or t
  misc_feature (278)..(278): n is a, c, g, or t
gagcaaatacagcaaggtagtatntgaaacagaagggtaaatacagagtggcagaaccctcagatccctcctttatgtctgagagagaggtagctgtagagatgtcttattaagactagaggtgctggcttgagaaatgctggctggacttctacagctgggtagatgttagacatgaagccggccgctgagtctggtgggagnaaactgcccgccttaacatcaccctgagcgcagcactaagatcctgagagacccctgggtcattctctaagctnggtctttttgatctggttatgctgctgctttttactttcccttcctgggtcattttctcctacacatcttctagtttgacaccttggggtagatccaagagactgagaagatggaggcatcctagtcatggcctcaacaaagctggggaaagaaaaactccttctgtcctctcttgacctttcatggaggggcactgtgtgttctactcaccatcctcactggaaacagaagagaggaaaaagcatcagattttagcagaaaggatagagggaagacatatggaaaaacttactcatgggatgaaagacttcagattggacctgcttctcttctgagatttttcttctgcctgccggtttgtttttgtgtctacctaagaggcattggatgaagcacagttacttttccaggcctcttccagacagcctcagcacagtttccatacagtgcactgcttcttggttcttctaaatgtcatgtagtatgtgtggtggttagatcacaagttttggagacagacagccctgggttccagtgccatctctgccacttaccagctgtgctaccttggtaattcacttaacctctttgagtcctagtttccttgtaaaatgcagaaaaacaactactcctta

SEQ ID NO: 9367 - DNA, 389 bp, Homo sapiens
aaaagggtagaagaaagcagaaatggaacaaaaagtagattggtcggttcaaaatttctttccttatagtgttaaaacagggaacatcctcatcatgctagcttaggtaatccgtactcctgattggctgctatgaatcttctgtttttggaaaactggcctgtttcagaggtcagtttgattatgtggcacctaatgtgaacgacttcattctggttggtttgatctcttggaacctcgtgcaggaagctagtccaaacagtggcctcccatactttgtttacatggcatagttcagaatataagctcatattatggtgtcatattatctaggtacaaattctgccttctctactccctagtttgtgataaggacaagttacttagca

SEQ ID NO: 9368 - DNA, 420 bp, Homo sapiens
accccacaaagtagaggtataaaggggttttgactaagcaagtgtcgtttgctccctggaggatgtgtcagctcttgcttcttttcaattgcttaagagttaaaaacgattactgtggtctcagaggacagacaccagcactgtgagctggatctcacccacagatgtgttcggcttgacccacatagttgtatacgcatatgtcagtttgttgcaacatacaaaaactggggggtttcacataaaaatctgcattttcaatttcttttttttaactgccaaatctgacaacactgtgtcttccctgcttcccctgtggaaacagtctgcctgactggggtaacagtgggctccctgggtacccacagtttaccagggccccacctgggcccactttcctccactcctgtttgtttccta

SEQ ID NO: 9369 - DNA, 620 bp, Homo sapiens
cgctctgggaggccaaggcaggagaatgacttgagaccagaagtttgagaccagcctgggcaacataacaagaccctgtctctacaaaaataaagatgaaaattagccaagcctggtggcttgtatctgtggttctagctactcagaaggctgaggcaggaggatctttagagcctaggaggtcaaggtggcagtgagctatgatcatgccgctgcactctagcgcttgcaacagaaccagaccctgtctctaaaagaaaaggaaaaacaagtcttatatttttatgataaaatgagttcacagctttgagagattcaaggcccatgcctcaatgactatgtcatttagccttagtttccttatctgtaaagcaatctgagcagggattatctctgtatcaccgggtgattgtagacatccaaagtaggtgctcacttcagcagcacatacattaaaattagaatgatacagagaagattagcgtggctcctgcacaaggatgacatgtttaaaaaaatatttttttaaaggagaaagaaaaaaaatcaaaagtagatgcaaaccattttatgatctcatgatctcaaaacaaagggaaaagagtaagattccatgtctc

SEQ ID NO: 9370 - DNA, 408 bp, Homo sapiens
tttttaagagacagggtctcactctgctattcaggctggagtgtagtggcatgatcatagctcattgcagcctcaaacttctgggctcaagtgattctcccacctcagcctcccaagtatctgggactacaggcacacaccaccatgcccagctaattaattttcttttatacagtattccagggaaaaggaaaggatgtttctctttaaatatgaccttctagtccaaatatgcttcactaattgagatattcaaagccactgtgtttataaagtctcaagttctcttccagattaaaagggaagaaaaacttcaaattcttctttataggaatctcaggaagaagaggcaagtgataacaatattctcctgaggcaaaaggactgtaacataatctgtccaaagaa

SEQ ID NO: 9371 - DNA, 1216 bp, Homo sapiens
aaaagtcccatatatttgacttcagcagttaaattgtattttcctgttttaccaaacctttttaattatcgtttcttgctgtagaaaaatcacataaaatctgctctttgcttaacaaattacagggtcgcttctgatttgtgtgctcgaaatactagtcaccaagcagaaactgatgactgtgagaataggcgactaattaacaaacaaacaaaaaaagccctttctcaacattggattgaccgagtgaaagttgacaggggaaagacacctcgattcagccatctttctccaacaggttgtactgctgactgcacagtctcccctgaaggactccggtcgctgtagccttggagagcgaccagattcctcaccccactcaggaggagccagggcaagattagggtgcagagaaatcggtttcctccagcctcctaccccagggaagaggaccgaagccagccccggcctcacgtgcatgcccagtcgggaggacgccctcagtgggagagccctgctcaggttctccccgaggccgaggtggtggtgggagcgggcggtggccccgggatcaaaggacctccgccgggttagctttggcagtgccgcagccaacccagcaggacgcttattttcaagcctggggaacgtagttcctcccgctttcacagcaggatggagcccgacggcaccccggttaaagggcctttccagagccctccggggaacggaaggccgcgctcctccgggagggagaacgacacactcttcgaggaaatcctggggcgggcgctctcctcgctgccgggacctttgtttctaagctggccacagctagagcagccttaagtgtcccaatgacacgcctgctatcgagcgccctcccggcggcccctcctcagccagctgcccagcgggcgtcctcaggtgtccccaagaggcgcaggcctagtcgcctacacgtcctttccaacttcgtcagctctggcttcccaccacccctcccggctctgcggcggcccagcctcttctccggttaattccggcctgtgcggcccggtcgtcccgtaaagaaggcaagcccgggttccgggtgaggggttggtgggtcagggtgggaaagcaaggcagcggtgagtcctctgctagcagatcgggctcaatatccccattccctgttttctccgggcccgccctccgcctctcaggcggccgc

SEQ ID NO: 9372 - DNA, 488 bp, Homo sapiens
acacaattccttcaccacaacacctaagattagtatttgattgagttactgggtgctacaacctagccaagttgagtcataaaactgaccatctctggaggtgtactctgcagtaaaaagctagctgaggcattattcacaccaagaaatgcagtgggtaccgaacaggagctccaaaaatatccaacgtctcattgacagaaagaagccactttagaatctgccttaccagaaggcaccaattgcagattacagctctgtcagtcacgtatggattaaacccctttcctctaacctcctccctctctttccaaccttggagggaccttccacaggagccagttagggaggagaagggaagagagagaatgaagcaggtaaccaggcccacccctctggaggagacagacctgaacaggggttgcttacaagcattgcatttggatcccaagatttgctattacaactaaattttgtctgttttgtaa

SEQ ID NO: 9373 - DNA, 3854 bp, Homo sapiens
tcttgcagtgtatgaaagtctgtgcacaggccgccttgttatcaagtgtcatgactggaatctccgtggggagcactaagagtatgtagtgttgcatgatataatccaagcctgtgggctgtgtcatccgggattgttggaattttgcatgtgtctgttccatatcccgctggtaaccagcttacagaccttctgtcaggttggcttacattatcatcaacaggttgccgtagtgatgatatgatgctggacacaatcattgtgcactttgttaatttggtatggtggtgccacacattatcactgtacagcattaacaaggctggaatatggccctctgctgtagggggcgtggcacctgtgacttgcactggaataagtaggaggctttccccaaaggatatggagactgatgtgtgctccatatcttgaggggagctctcttggtttcctttggccgggtctgttagttacttttgaaggccatgccaacccttttaggccattaaatttttctcaaacaatagccagcctcatttctgcttcatctctgtggtaggaaccattccctactcttactccctcctcttgtccaacttccaccaaacactcaatccgagtcctggctgctttcttgcttaggtctgtggctggtaactgtggtgaaagagtcaaggtgggcagtgtttggggtaggaaatgagtagtggtgaagcagcagcagtgtgtgtgtgggtgtgggtgtgtgtgcatgcgtgtgcatttgcatgtgtgtatgttgacaaatgagagtgtagccataagatttcattgttactactagtctttgtgtacctatctggagggacattaaaaaaatatggccattctcccatctagggggttcccatctcagacttctctgataagagtaatttgagaacaaatacagattcatctatgggaaaagatgtttaaactcagcatgaaggagaaacaaatttaggagtggaaagcaaggcaggtagttaggtgatttccatgaccacatttgcttgggccagggaagtggtgcacctcttttataacaatgggagatttcagaaacagtttgagtgttggcagaccaatgccctgataagcttgtggtatagaggtaggaagggagggaggccagagattagataaaatgatggtgggtgggatcttagctctaaatgaaaagaactggacttactaagtgggtggattacttgctagccataacttttagggaagggtaggtctggagagaaggtgaagaccagcagaaatatactgtgaaattgccaaatatgtttggttgcagaaaacacagcctggctctttgtggctagatgtgacttccaacttctgaagacaggattgccaagagatgtgatctttccacatacagctcctgtccccatctctttatgtgtagagacctggatttggggtagtggggtagtaaaccatatatttccaaaagatggtgtgaagagtcgtttctcttcgtctgggatgtgattggcttttgttttttgttttttgtttttgagacggagtctcgctctgtcgctttgtcaccaggctggagtgcaatggcacaatctcagctcactgcaacctccgcctcctggcttcaagtgattctcctgcctcagcctcctgagtagctgggactataggcgcgcaccaccatgcccagctaatttttgtatttttagtagagatgggatttcaccatgttggccaggatggtcttgatctcttgacctcatgatccacccgccttggcctcccaaagtgctgggattacaggcttgagctactgcgcccggccagtgattggcttttaaattaatcacaaatgtttgataaaattctggtatgtgctaagtcccaggcttggttgatatctcagactatgatagctgtgaccttcaagaaatttctggcttggggaatctgtagtttctggttgtccaaaaaagatagttcttagtcctactttattttctacccactcaactctccagacttccctcttagtaaaggaattcataattctccctgcatcttctctgtttatttcaatgtccatgttctgagtctcaagttttcctgaagcacaggagcaggcttggccccagagcccctggctttttcaacgagcatcagaaatgctatcaatatattctctctgttgctttatcagcttctctaaatttattttgtaaggaagttagcacctccttccaggactttaaacagttgtctttgccaatttgttcctggattttccttgaacttctcaggtttccaagccacatcctagcagggcatccaggagccttgcactgaacctctcagctcttttgactttcttctggtcataggtgttgggcctcccattaggtagaagtcctttgagcagacccgaaatggccaaatgagacatcatccaagttcctccctcctttactgtctcggctttttcaagcacccctttcacctctcttttctgccttttcctcagtctgtcaagttctttggaggaaagaagttcttggtcagaggtcctaaaaccaccaccagctgggggtgctgagaatggtgaggagttggacagtcccggggcttttttgaaaggggactttatggtcatttcccctgtttagggtgagggactaagaattctcaagccttcagtttcatccatatttcaatgtaagcagaaaagcacatctcaaagccaaatagaaatgattttctactaagcctatcctttgtgattcttggttcccttggtctcttaatattaattatagagaatgggcagttgagtcagttaacatcttttcatcagaaaggagggtaatattcataaccaaaagagatgtaaaggaagtatattactgcttgaagtgtgaaaagaggaaaggagtgttatgtgaaccttttcagtagggaaattcagaaaatggaatgattcatccataggcataattcttttaggagattctgtgctcaaagggaagggaatggtttctgatccttctgaagagaaaaggaatagcatttttcttaaacctaacccagtttcagcattggagaatacagaactttttcttctagctgatggcattaatatttcttgagagagagaactcacccatggcacttttctgagcccagcagaaatcagcggagcttgggcttcgcttagcaggtttgcaattgacttcaacatgcaggcttttcacatgtgcaataatgctggaaacagaagcaccaaactgattgtgcaattactccttttgtagaagaggccaaaatcctcctcctccttcctttctcctatattcactcctccaggatcataaagcctccctcttgtttatctgtgtctgtctgtctgattggttagatttggctccccttccaagctaatggtgtcaggtggagaacagagcaaccttccctcggaaggagacaattcgaggtgctggtacatttcccttgttttctatgttcttctttctagtgggtctcatgtagagatagagatatttttttgttttagagattccaaagtatatatttttagtgtaagaaatgtaccctctccacactccatgatgtaaatagaaccaggaataaatgtgtcattgtgataatcccatagcaatttatggtaagaacaagacccctttccctcaccaccgagtctcgtggtctgtgtctgtgaaccagggcaggtaattgtgacactgcatctcatagaactctgcctgcccagatttttgtgtgctcacctcaatgggtgaaaaataaagtctgtgtaaactgtt

SEQ ID NO: 9374 - DNA, 576 bp, Homo sapiens
cagggttttacgacaccagggtatcccaccttttttgcaacataggcagaaacaccaagctgtgggtaattgatgtgcgtgtcactgattcctgcaacagctttgaatgtattaaatctgttttcaacagcccttgcataggtgttatctctcaaatctctgtaaagagcactaagagtatgtagtgttgcatgatataatccaagcctgtgggctgtgtcatccgggattgttggaattttgcatgtgtctgttccatatcccgctggtaaccagcttacagaccttctgtcaggttggcttacattatcatcaacaggttgccgtagtgatgatatgatgctggacacaatcattgtgcactttgttaatttggtatggtggtgccacacattatcactgtacagcattaacaaggctggaatatggccctctgctgtagggggcgtggcacctgtgacttgcactggaataagtaggaggctttccccaaaggatatggagactgatgtgtgctccatatcttgaggggagctctcttggtttcctttggccgggtctgttagttacttttga

SEQ ID NO: 9375 - DNA, 323 bp, Homo sapiens
tccatctcgtttcatactaaggtgaggtgattcagatctgttgatggacccataaataatcatagtagatttgctttgttcctcagaagcagcagtttcttaggaagaggaagaaggcccttttaaactgtaaatcactcccgttccctctcagctcctgtttgcttagggtgtgtggttccccgacgtcgccatgtggacacagcatatgagccacactctggctggaatatcagcacacgcatttgagaacactgccttactgttctgtggcatatttagctttttctgttcctgactgcaaacggcattactcttttctt

SEQ ID NO: 9376 - DNA, 336 bp, Homo sapiens
aaacaaagagagagagatagagagatatcagaggatacattctgccacctgtgttcattcatgactgattatcaaaagaaatttctggttcttgacaaaacattttctgttcatagagaaattgttcagttcaactgggcatgggtttgctttctgtcacttgctggaaattctttactggaacaaaaagtctagtgcttgtgcataagggaagacatagacatgtggtccttcctcacacctgcttcctcactcctgcttcctttttgctcctcatttttcttttccatcttaacttttccccatcacttgagccttcagtaagtgtgagataat

SEQ ID NO: 9377 - DNA, 452 bp, Homo sapiens
ctaggttgcctaggaatctgcagtttaaataagcacccctggctaatcagtgaatgtggtctgcaaccatactttgagaaacattgagtggatagcctttatttaactcctgagacagaaatgtggggggaaccttcaaacactgaccaaccgacactgcctatccatgctattaattcaagaagggctagttttgcatgcactttctctcatgtgcagagcaactacacataggtgagtcaagtttcactcacaggatgacattctgtctgttccgggctcatcatgtgagactacagaggggtgacttactcagcctctaaaagttcagccaacagaggaaaaactggcacagctgtgaataccactatccccttggctctcactcttgtaacacaaggcagtggagattcagagaccaaggaaccccagagctgtgtaatggatcagga

SEQ ID NO: 9378 - DNA, 339 bp, Homo sapiens
aatgcaagcgtgacagagaaacctctttcgaatgacttactacaactctggcattggttagttccatgtattgtaagattctggtgctaatgctccatacagaattgatcaggactgattactcttctgtggaccaattgctattgaactacccagctgaagagggtttggggagagaacgttcattattatggactccacttttgtcccctggtagtttaagggtgatactagaatccagagaagttcctgtctccttgtggcctcaaacactcaggccgtctcaaaagcttttcaccaaggtgcaaaatcatttacctgcattccacacatcttttc

SEQ ID NO: 9379 - DNA, 585 bp, Homo sapiens
cagaaacacagtgtgggtccaacaatctgttttaacaagtcctctggttcgctccaggctccagggtgggacagtcactggtgcttctgctggctgggacaacagggccccactgtggaacttgaagcctgtgaccccctcctaacggctcctctcagttcccgtggtcccaaaagccctctgtcccgtgcagggctgccccacagtggccttccacatcctcctgatagcagaggcccccgccacccccagggccacctctgcagctgtgccgcagcttctctgcccaggcacctgcactgacacggagcaccctgtaggttgtctgcttgaggcctttacctaaatgcttgccgcagctgtttctaaactacaaaagcacacaatcatgaaatgaggcagaggtgggctgagtgccacaatggatgccaagaggaagagagatggacatggcgctgggaggctctgggcaccactggaggggggcgctgagttcccgggctgccccggctgggagaggagtcgagtcttaatctcctttaaggaaacataataaataaactactttgccactaaaaaaaaata

SEQ ID NO: 9380 - DNA, 214 bp, Homo sapiens
gtgcatttgataaacaaacaaaaacaggaaattaaaaagaaggaatggtagaatatcctcggaaatacttgactaagaaaagccaaaaaacatataacacacacacatagaagtccttctctttcttttgaaatgatccaaattgaaaatgatatcgatgcctaagtaaaaactgccttagtatgtcacaggcctggagaaagcaaaatgaaat

SEQ ID NO: 9381 - DNA, 412 bp, Homo sapiens
catagttctccccacataagacactgtgacatatttctgggccaattacataagttaaatgagtctttgcttatgcctggatctcaccctcagaagaacttatgacatgttgctggacccagcacctagctacaggtgggattgtgacatatgcctgggacgtggtcactggtacaatgatgacacccacaaacttcaacccacaaaccaggagaaatattgattctgtctgctaggctttgggcaacagcagagacggggtttcaccacgttggccaggctggtcctgaactcctgacctcagatcaacttgtaactgctcctaatcaaagtgtagatgacaggcaacttgaaggtttgctcccaggttacaatcctcaagctttgcccaaataaacggtctacttacatt

SEQ ID NO: 9382 - DNA, 507 bp, Homo sapiens
gcaaatactacccattatttaagtccagaggagggcagctcacctgagtatccagctgcactgtaataatgacgaatctgggtggtagagccagaagcctcagcttaaatcctgacgctgccagaacctacatttggcttatgcaaaatttcctcaaagactggcagtgagggctaaataacttagcccctgaaagttctcagaatagtgtctggagtatagtaagttttcattaaatgttggctattaacattgagacttctgttagaccaaatataacagtccatacaacttgcagaatattgaaaacaaaatggtaaacatataaatgacagagggcaacttaattggaggttgtagagaaatatttagaatcattaaaaatgaaatcattttgaattttctattgtgttacatactaaaattaacattaggaaacaatgtgaagtaaaggtgtagagtgaaatggctaaacttattttcataaagtgaaagcatttcccttcc

SEQ ID NO: 9383 - DNA, 5142 bp, Homo sapiens
gccgccgctgcccggagcctgggctcggctacccccccgccggcccccaccgagcggagctctgcttcctcctcgccgcatccctgagggaagcgccgcctctgctcccgggttctccgcccgccgactccttcctggccggaccccgctgcgctccaccccagtggctggaggagcagctctccagtcagcctttgcagcccctctctttttccctttccaccgggcctcctcggatcccttggctgggcactgaggcgggggaagaggctggggtcgccacggcggaggttgctgccgccacccccctgcgggggtggccggggttcccggctgggggggtaccgttctgggtgaggcatccaccatggtgaggcccctgtgccgtgcccccgcgcccccccggccgccgctgcctcctgcccctcggtgctgctgttgctcccccgcctgctgttgctcctccatctccagatcggatcacggtgagggaaacgatgagcgaggagacggcgacttctgacaacgataatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtggttttggaatgtatgcttaaaaaagacctcatttataataaggtcactccaacatttcaccactggaagattgatgacaaaaagtttggtcttacgtttcaaagtcctgctgatgctaggggcttttgatagaggtatccgaagagctatagaggatatttctcaaggatgccccgaatcaaaaaatgaagctgaaggggcagatgacttacaagcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcagataacatttggtcagccaggcttggacattcagagcagaagtatggaatacgtacagcggcaaatatccaaggaatgtggaagcctaaagtcccaaaatagggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaagttaagttcacccaaagactctgtggtatttaagacgcagccttcctcattaaaaattaagaagtcaaaacgaagaaaagaggatggtgaacgttctcgctgcgtatactgccaggaaaggtttaatcatgaagaaaatgtcaggggaaaatgtcaggatgctccagaccctattaaaagatgcatatatcaagttagttgcatgctctgtgcagagagcatgttgtatcattgtatgtcagactcagagggagatttttctgatccctgttcgtgtgacactagcgacgacaagttctgcttgcgatggttagccctggtagctttgtctttcattgtaccatgtatgtgctgctacgtccctttgagaatgtgccatcgctgtggtgaggcatgtggttgctgtggtgggaaacataaagctgctggatgaaatggtccagtgccaaaatgagcttaaaatctttgtttccaggaattagctaacttggatttgtggaagcttttggcaagcaatatggaatcttgcctggtatcattgagcccacacatggaggaagcagaactcatcagttcttggcgtttcacgccatgcctaacttttcccttgagtgcatggcatgttttgttacaggttgtagagtatttgcagaaggaaaccatttctggttatttggctataaaaagtcagcataaaatatgatccaactaaaagggattaatttttggcatttttgtatatttatgcattaggtgatgggacttttaaaggtttgaatttattaggacacgaactaaaaataaaagtgcactaggggacagttgatttcaatctaagaaaagttaacacttgggaattacaagaagtaaaacaagtgcaactaaatcatttattagttgttttttgaaagcagttttatgtataaataacaaatgtttatatttaactaaatgtaaggtacgaattattacatattaaacttttcttccccttcctagttctgaagtagatatatatatatatatatctactgtcacattccatatattttgaatatttaactcatctagttaataatgtttttattccatgcgaatgatttgatattttcatccttatttctctttggctacaatttatattgagttatatctgtacattctggtaatctaaaatccttaaaaatactctaatagccttgagtgaccaactttttttttaaagcacagatgtaattgtctaatgttctgatgggaacgtaacacttatttttatataaaaagagactgagtaaacaaacattatagaaaaaaagtgaagttttttagttgttttttgtggtattcaaccagcaagttgttttctttcagagtttcctccttcaaaaagttatattgcatttacaaatgttttacaaggcagaaagtttgactggatagttagtgtaaaagcttcatgttgagatcttcacgtatcattctgctaaaccagaatatgttcagctgtgttactaatttttcagcttaatcctcagtgcttattatttacataacaataactttttatcagttacattttatttttatttaaactggccaaaagcaaaattattttatgttaaaatgtgtgctaaactatcccaggaaagtatttaatccaacattgtaaatgaagtatcttgtacatataaatttatttcttttgcagagcattatattactggatgtttaatttacaaaatagttgggtaaatgttccaacaaactttaaagtaccttgaagtcaaattgtctgtttttgttttgttgttgttgttgttgttttcttaagtgttacattaaaactctaaccaaggaaagggttctttaagaacattcccttagagggataaagttgagaagtgtgccttttttttaatggcttgaagtttcagaggtgataaaaattaaaatcacactactatttgaagctcattttctatgcaggtttttaaacgtcatttatgtatcattctttttatatatcacacttaagcttgtgttagcttttttcttttgccccagatcaaactgaacaatgtatatacactatctgtctgtaaaatactttttttaagaaagcatttatatttatatgacagcttgaactgacaacattgtgtatatagatcatcttgaagtattatttcacattgaaaagaagaaaatatattgataactatagatgttatgaagaagagggtatttctagttttgtactaaaaatcaattggatgaactaaatccaaaacatgacactgtaggcagcagttttaagtcttatttttactgtttatatatttgaatgctgctacaacagatgatcttcatccctgaagttttcagctaaacttggtttcctagaatagactgttaactttcaaaatttttattggtgaaatggaaatactgtttttccttgtgaatgaattttcatatttgtaagtgctaagtttataattcaggtttgatcaaggtgtgaataactgaagaaaataacttgctggctatataggaaaatgctgtggaaatgaactgtgtatatacttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcttcattaaaaactatggtgatgaaatggtttttattttaccttggatctttatagttaacatacccagtttcttaatcagtctacaagactaactgatgatataatgttctctgaatccctatatggaaattttcttttgagtaaatgagaattcctttgtgaaagcaaatgggtagtttaaatcactgattcttaaacatgtgtataggcaccttcaggaacattttctcattctctgtacagattcggcactgccaattggcttttcctctaaaacttttctttgtttttatctgatataagcagatggctcaagacaactgcttgagtaatagtattgaaaatggaatcatctagacggcatgacaagcaagactggtctgatgaacttgttcagaattgataattcttaaatatttctcttggcttcaaaagggacatcatttgatttctgaagaagtatgtcgtgtggagcttcagcaccacctactggatgatttccaggccagagacatgagatggcaatagggatctgacagggttcatcactactaccattaaagggctatttatgtggtgaccacctctaccagggaaaccaggaataagaactgtctcaaaggaattgtaaaatggttatttacctaatgtgtcttgttggcttgctgaaagattttaagcacttttttcttacatatcctgttttaaaatatttgttgatatttgggactggcaatcaaacttaatggatgtactgaggcatttatagaaccagttgctttaactctcaaaagccattaccaaaatggtatttttttcctccttccgccagtcagggagaatttttaaaaataataatcaaaacatgaaaaaacataatcacacctgtattttatcatcactgcactccagcctgagtgacaagaacaagactccatttcaaaag

SEQ ID NO: 9384 - DNA, 3882 bp, Homo sapiens
gccgccgctgcccggagcctgggctcggctacccccccgccggcccccaccgagcggagctctgcttcctcctcgccgcatccctgagggaagcgccgcctctgctcccgggttctccgcccgccgactccttcctggccggaccccgctgcgctccaccccagtggctggaggagcagctctccagtcagcctttgcagcccctctctttttccctttccaccgggcctcctcggatcccttggctgggcactgaggcgggggaagaggctggggtcgccacggcggaggttgctgccgccacccccctgcgggggtggccggggttcccggctgggggggtaccgttctgggtgaggcatccaccatggtgaggcccctgtgccgtgcccccgcgcccccccggccgccgctgcctcctgcccctcggtgctgctgttgctcccccgcctgctgttgctcctccatctccagatcggatcacggtgagggaaacgatgagcgaggagacggcgacttctgacaacgataatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtggttttggaatgtatgcttaaaaaagacctcatttataataaggtcactccaacatttcaccactggaagattgatgacaaaaagtttggtcttacgtttcaaagtcctgctgatgctaggggcttttgatagaggtatccgaagagctatagaggatatttctcaaggatgccccgaatcaaaaaatgaagctgaaggggcagatgacttacaagcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcagataacatttggtcagccaggcttggacattcagagcagaagtatggaatacgtacagcggcaaatatccaaggaatgtggaagcctaaagtcccaaaatagggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaagttaagttcacccaaagactctgtggtatttaagacgcagccttcctcattaaaaattaagaagtcaaaacgaagaaaagaggatggtgaacgttctcgctgcgtatactgccaggaaaggtttaatcatgaagaaaatgtcaggggaaaatgtcaggatgctccagaccctattaaaagatgcatatatcaagttagttgcatgctctgtgcagagagcatgttgtatcattgtatgtcagactcagagggagatttttctgatccctgttcgtgtgacactagcgacgacaagttctgcttgcgatggttagccctggtagctttgtctttcattgtaccatgtatgtgctgctacgtccctttgagaatgtgccatcgctgtggtgaggcatgtggttgctgtggtgggaaacataaagctgctggatgaaatggtccagtgccaaaatgagcttaaaatctttgtttccaggaattagctaacttggatttgtggaagcttttggcaagcaatatggaatcttgcctggtatcattgagcccacacatggaggaagcagaactcatcagttcttggcgtttcacgccatgcctaacttttcccttgagtgcatggcatgttttgttacaggttgtagagtatttgcagaaggaaaccatttctggttatttggctataaaaagtcagcataaaatatgatccaactaaaagggattaatttttggcatttttgtatatttatgcattaggtgatgggacttttaaaggtttgaatttattaggacacgaactaaaaataaaagtgcactaggggacagttgatttcaatctaagaaaagttaacacttgggaattacaagaagtaaaacaagtgcaactaaatcatttattagttgttttttgaaagcagttttatgtataaataacaaatgtttatatttaactaaatgtaaggtacgaattattacatattaaacttttcttccccttcctagttctgaagtagatatatatatatatatatctactgtcacattccatatattttgaatatttaactcatctagttaataatgtttttattccatgcgaatgatttgatattttcatccttatttctctttggctacaatttatattgagttatatctgtacattctggtaatctaaaatccttaaaaatactctaatagccttgagtgaccaactttttttttaaagcacagatgtaattgtctaatgttctgatgggaacgtaacacttatttttatataaaaagagactgagtaaacaaacattatagaaaaaaagtgaagttttttagttgttttttgtggtattcaaccagcaagttgttttctttcagagtttcctccttcaaaaagttatattgcatttacaaatgttttacaaggcagaaagtttgactggatagttagtgtaaaagcttcatgttgagatcttcacgtatcattctgctaaaccagaatatgttcagctgtgttactaatttttcagcttaatcctcagtgcttattatttacataacaataactttttatcagttacattttatttttatttaaactggccaaaagcaaaattattttatgttaaaatgtgtgctaaactatcccaggaaagtatttaatccaacattgtaaatgaagtatcttgtacatataaatttatttcttttgcagagcattatattactggatgtttaatttacaaaatagttgggtaaatgttccaacaaactttaaagtaccttgaagtcaaattgtctgtttttgttttgttgttgttgttgttgttttcttaagtgttacattaaaactctaaccaaggaaagggttctttaagaacattcccttagagggataaagttgagaagtgtgccttttttttaatggcttgaagtttcagaggtgataaaaattaaaatcacactactatttgaagctcattttctatgcaggtttttaaacgtcatttatgtatcattctttttatatatcacacttaagcttgtgttagcttttttcttttgccccagatcaaactgaacaatgtatatacactatctgtctgtaaaatactttttttaagaaagcatttatatttatatgacagcttgaactgacaacattgtgtatatagatcatcttgaagtattatttcacattgaaaagaagaaaatatattgataactatagatgttatgaagaagagggtatttctagttttgtactaaaaatcaattggatgaactaaatccaaaacatgacactgtaggcagcagttttaagtcttatttttatttaagaaatacatttaataaggctgtagctgccctaactagtgattcctctgaagagtctgggcaaagtctaattgaaaaccttctgggaagcatttagcattctagatgcctactaagaacattctgattcatgggaggcggtcgaatatgc

SEQ ID NO: 9385 - DNA, 3287 bp, Homo sapiens
tcccactgctcatcagtagcgacactgtttatatatttgaatgctgctacaacagatgatcttcatccctgaagttttcagctaaacttggtttcctagaatagactgttaactttcaaaatttttattggtgaaatggaaatactgtttttccttgtgaatgaattttcatatttgtaagtgctaagtttataattcaggtttgatcaaggtgtgaataactgaagaaaataacttgctggctatataggaaaatgctgtggaaatgaactgtgtatatacttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcttcattaaaaactatggtgatgaaatggtttttattttaccttggatctttatagttaacatacccagtttcttaatcagtctacaagactaactgatgatataatgttctctgaatccctatatggaaattttcttttgagtaaatgagaattcctttgtgaaagcaaatgggtagtttaaatcactgattcttaaacatgtgtataggcaccttcaggaacattttctcattctctgtacagattcggcactgccaattggcttttcctctaaaacttttctttgtttttatctgatataagcagatggctcaagacaactgcttgagtaatagtattgaaaatggaatcatctagacggcatgacaagcaagactggtctgatgaacttgttcagaattgataattcttaaatatttctcttggcttcaaaagggacatcatttgatttctgaagaagtatgtcgtgtggagcttcagcaccacctactggatgatttccaggccagagacatgagatggcaatagggatctgacagggttcatcactactaccattaaagggctatttatgtggtgaccacctctaccagggaaaccaggaataagaactgtctcaaaggaattgtaaaatggttatttacctaatgtgtcttgttggcttgctgaaagattttaagcacttttttcttacatatcctgttttaaaatatttgttgatatttgggactggcaatcaaacttaatggatgtactgaggcatttatagaaccagttgctttaactctcaaaagccattaccaaaatggtatttttttcctccttccgccagtcagggagaatttttaaaaataataatcaaaacatgaaaaaacataatcacacctgtattttatcatgacagcttcagagagtgtgtgtgtacgtttttctctcttttatttgagacggagtttcactcttgttgcccaggctggagtgcaatggtgcgatctcagctcactgcaacctccgcctcctgggttcaagcgattctcctgcctcagcctcccaagtagctgggattacaggcacccaccaccatgcccagctaagttttggtattttagtagagatggggtttcaccatgttggccaggctggtcttgaactcctgaccttaggtgatccacccacctcggcctcccaaagtgctgggattacaggcatgagctactgcgcccagccgtgtgtatgtttctgaaatgatgatggggtggggttaaaatctaaagggaaaaacttgaaactacctattttcattggttattcagcagtgcctaaaatgagcttttgaagtaatgtaaatgcactttcaattcatgtgtatagtgccatctgatatcttgggtaagtcttgctttttcttttctttttcctctcccctgcccccttaattaaatggcacggaaatgtttcttaatatgcacgtgagtctccagagtacaggaaatgtgctttcctctaaatggtcaatgtaaagaatcttaaggatatttcttgtgttgaaatttacattcgattttgtgattacacttggaaatatgtgttaaattgggtttttaattgtagcccaaaggtgcattaagcaagtgtaacattttttccacataaaacttagaaaactttagttacctgaaaagcaaggattctttactaattattatgctcattcttgatttgacttccatgttcacacttcaaagtgtaagaggaagcactagaaactggcattattgttgcactaaaaaagtctataaatcataatagcaccatgaggtgttttgcaatgagacaaacatgaagaatgaatttctttaagagagaaacacaaccggaggtgatttatataaaccaaaagaaaaaaaaaggctttaaggtattaggtactgtttgcctagcagccaggtggttataaaagattcatatgctttggtacactgataaatgttagccattattcctgaaagcttcttaaattgcatcagttgttttgaaattttttcaagaataaactagttgaaaagtctttgtattaaaaatacacatagatttttgtgaacatttccagtgtgtagtgtcgtttgctttctatttctgacctcaaaagtgcctcacttgtatattatttccattaaaagcttgactgcattctttctaatgaacaatgaaaaactgtttaactcatgtcataatgtgtctcctcagatatagttaactagcttgatagttttgagtatataatgtaaataatacataataagtttgtaaccatttctgttacttcatacccgtgtaattggacatagcagatgattatcataagaatttgttttaatggtttttttccctcctggaattacctgattaacctgtcatgaattataaaaggactttttcttattctcctagagcttatcaaattatcacataagagataattactggaggagaaagtaaaaatggaagcttttgataattagctctgttctttaaaagtatacttttaaactgaaagttcacatatagttcatcttaataacatatttattcatccttaattgtattcagatttttttttaagtctctaagctaataatgttatatttattggtttggtaacatgttgcagctaagctaatgaccttaagtggcaattgtttaacccaggactactgatttttttatattcaagtcagtttcatcgttttacttaactcgccatataaccaaaaataacgaataatctaaaggaa

SEQ ID NO: 9386 - DNA, 162 bp, Homo sapiens
cattgagggttgttcccaataggcaaatgaagaggattcttccagttctctagtgaaggatcacctttttcagcaagagacagttgttaccagtgagccttatagaagctcaaatataagaccttctccctttgaagatctgaatgccagaagagtctacat

SEQ ID NO: 9387 - DNA, 6991 bp, Homo sapiens
gccgccgctgcccggagcctgggctcggctacccccccgccggcccccaccgagcggagctctgcttcctcctcgccgcatccctgagggaagcgccgcctctgctcccgggttctccgcccgccgactccttcctggccggaccccgctgcgctccaccccagtggctggaggagcagctctccagtcagcctttgcagcccctctctttttccctttccaccgggcctcctcggatcccttggctgggcactgaggcgggggaagaggctggggtcgccacggcggaggttgctgccgccacccccctgcgggggtggccggggttcccggctgggggggtaccgttctgggtgaggcatccaccatggtgaggcccctgtgccgtgcccccgcgcccccccggccgccgctgcctcctgcccctcggtgctgctgttgctcccccgcctgctgttgctcctccatctccagatcggatcacggtgagggaaacgatgagcgaggagacggcgacttctgacaacgataatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtggttttggaatgtatgcttaaaaaagacctcatttataataaggtcactccaacatttcaccactggaagattgatgacaaaaagtttggtcttacgtttcaaagtcctgctgatgctaggggcttttgatagaggtatccgaagagctatagaggatatttctcaaggatgccccgaatcaaaaaatgaagctgaaggggcagatgacttacaagcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcagataacatttggtcagccaggcttggacattcagagcagaagtatggaatacgtacagcggcaaatatccaaggaatgtggaagcctaaagtcccaaaatagggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaagttaagttcacccaaagactctgtggtatttaagacgcagccttcctcattaaaaattaagaagtcaaaacgaagaaaagaggatggtgaacgttctcgctgcgtatactgccaggaaaggtttaatcatgaagaaaatgtcaggggaaaatgtcaggatgctccagaccctattaaaagatgcatatatcaagttagttgcatgctctgtgcagagagcatgttgtatcattgtatgtcagactcagagggagatttttctgatccctgttcgtgtgacactagcgacgacaagttctgcttgcgatggttagccctggtagctttgtctttcattgtaccatgtatgtgctgctacgtccctttgagaatgtgccatcgctgtggtgaggcatgtggttgctgtggtgggaaacataaagctgctggatgaaatggtccagtgccaaaatgagcttaaaatctttgtttccaggaattagctaacttggatttgtggaagcttttggcaagcaatatggaatcttgcctggtatcattgagcccacacatggaggaagcagaactcatcagttcttggcgtttcacgccatgcctaacttttcccttgagtgcatggcatgttttgttacaggttgtagagtatttgcagaaggaaaccatttctggttatttggctataaaaagtcagcataaaatatgatccaactaaaagggattaatttttggcatttttgtatatttatgcattaggtgatgggacttttaaaggtttgaatttattaggacacgaactaaaaataaaagtgcactaggggacagttgatttcaatctaagaaaagttaacacttgggaattacaagaagtaaaacaagtgcaactaaatcatttattagttgttttttgaaagcagttttatgtataaataacaaatgtttatatttaactaaatgtaaggtacgaattattacatattaaacttttcttccccttcctagttctgaagtagatatatatatatatatatctactgtcacattccatatattttgaatatttaactcatctagttaataatgtttttattccatgcgaatgatttgatattttcatccttatttctctttggctacaatttatattgagttatatctgtacattctggtaatctaaaatccttaaaaatactctaatagccttgagtgaccaactttttttttaaagcacagatgtaattgtctaatgttctgatgggaacgtaacacttatttttatataaaaagagactgagtaaacaaacattatagaaaaaaagtgaagttttttagttgttttttgtggtattcaaccagcaagttgttttctttcagagtttcctccttcaaaaagttatattgcatttacaaatgttttacaaggcagaaagtttgactggatagttagtgtaaaagcttcatgttgagatcttcacgtatcattctgctaaaccagaatatgttcagctgtgttactaatttttcagcttaatcctcagtgcttattatttacataacaataactttttatcagttacattttatttttatttaaactggccaaaagcaaaattattttatgttaaaatgtgtgctaaactatcccaggaaagtatttaatccaacattgtaaatgaagtatcttgtacatataaatttatttcttttgcagagcattatattactggatgtttaatttacaaaatagttgggtaaatgttccaacaaactttaaagtaccttgaagtcaaattgtctgtttttgttttgttgttgttgttgttgttttcttaagtgttacattaaaactctaaccaaggaaagggttctttaagaacattcccttagagggataaagttgagaagtgtgccttttttttaatggcttgaagtttcagaggtgataaaaattaaaatcacactactatttgaagctcattttctatgcaggtttttaaacgtcatttatgtatcattctttttatatatcacacttaagcttgtgttagcttttttcttttgccccagatcaaactgaacaatgtatatacactatctgtctgtaaaatactttttttaagaaagcatttatatttatatgacagcttgaactgacaacattgtgtatatagatcatcttgaagtattatttcacattgaaaagaagaaaatatattgataactatagatgttatgaagaagagggtatttctagttttgtactaaaaatcaattggatgaactaaatccaaaacatgacactgtaggcagcagttttaagtcttatttttactgtttatatatttgaatgctgctacaacagatgatcttcatccctgaagttttcagctaaacttggtttcctagaatagactgttaactttcaaaatttttattggtgaaatggaaatactgtttttccttgtgaatgaattttcatatttgtaagtgctaagtttataattcaggtttgatcaaggtgtgaataactgaagaaaataacttgctggctatataggaaaatgctgtggaaatgaactgtgtatatacttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcttcattaaaaactatggtgatgaaatggtttttattttaccttggatctttatagttaacatacccagtttcttaatcagtctacaagactaactgatgatataatgttctctgaatccctatatggaaattttcttttgagtaaatgagaattcctttgtgaaagcaaatgggtagtttaaatcactgattcttaaacatgtgtataggcaccttcaggaacattttctcattctctgtacagattcggcactgccaattggcttttcctctaaaacttttctttgtttttatctgatataagcagatggctcaagacaactgcttgagtaatagtattgaaaatggaatcatctagacggcatgacaagcaagactggtctgatgaacttgttcagaattgataattcttaaatatttctcttggcttcaaaagggacatcatttgatttctgaagaagtatgtcgtgtggagcttcagcaccacctactggatgatttccaggccagagacatgagatggcaatagggatctgacagggttcatcactactaccattaaagggctatttatgtggtgaccacctctaccagggaaaccaggaataagaactgtctcaaaggaattgtaaaatggttatttacctaatgtgtcttgttggcttgctgaaagattttaagcacttttttcttacatatcctgttttaaaatatttgttgatatttgggactggcaatcaaacttaatggatgtactgaggcatttatagaaccagttgctttaactctcaaaagccattaccaaaatggtatttttttcctccttccgccagtcagggagaatttttaaaaataataatcaaaacatgaaaaaacataatcacacctgtattttatcatgacagcttcagagagtgtgtgtgtacgtttttctctcttttatttgagacggagtttcactcttgttgcccaggctggagtgcaatggtgcgatctcagctcactgcaacctccgcctcctgggttcaagcgattctcctgcctcagcctcccaagtagctgggattacaggcacccaccaccatgcccagctaagttttggtattttagtagagatggggtttcaccatgttggccaggctggtcttgaactcctgaccttaggtgatccacccacctcggcctcccaaagtgctgggattacaggcatgagctactgcgcccagccgtgtgtatgtttctgaaatgatgatggggtggggttaaaatctaaagggaaaaacttgaaactacctattttcattggttattcagcagtgcctaaaatgagcttttgaagtaatgtaaatgcactttcaattcatgtgtatagtgccatctgatatcttgggtaagtcttgctttttcttttctttttcctctcccctgcccccttaattaaatggcacggaaatgtttcttaatatgcacgtgagtctccagagtacaggaaatgtgctttcctctaaatggtcaatgtaaagaatcttaaggatatttcttgtgttgaaatttacattcgattttgtgattacacttggaaatatgtgttaaattgggtttttaattgtagcccaaaggtgcattaagcaagtgtaacattttttccacataaaacttagaaaactttagttacctgaaaagcaaggattctttactaattattatgctcattcttgatttgacttccatgttcacacttcaaagtgtaagaggaagcactagaaactggcattattgttgcactaaaaaagtctataaatcataatagcaccatgaggtgttttgcaatgagacaaacatgaagaatgaatttctttaagagagaaacacaaccggaggtgatttatataaaccaaaagaaaaaaaaaggctttaaggtattaggtactgtttgcctagcagccaggtggttataaaagattcatatgctttggtacactgataaatgttagccattattcctgaaagcttcttaaattgcatcagttgttttgaaattttttcaagaataaactagttgaaaagtctttgtattaaaaatacacatagatttttgtgaacatttccagtgtgtagtgtcgtttgctttctatttctgacctcaaaagtgcctcacttgtatattatttccattaaaagcttgactgcattctttctaatgaacaatgaaaaactgtttaactcatgtcataatgtgtctcctcagatatagttaactagcttgatagttttgagtatataatgtaaataatacataataagtttgtaaccatttctgttacttcatacccgtgtaattggacatagcagatgattatcataagaatttgttttaatggtttttttccctcctggaattacctgattaacctgtcatgaattataaaaggactttttcttattctcctagagcttatcaaattatcacataagagataattactggaggagaaagtaaaaatggaagcttttgataattagctctgttctttaaaagtatacttttaaactgaaagttcacatatagttcatcttaataacatatttattcatccttaattgtattcagatttttttttaagtctctaagctaataatgttatatttattggtttggtaacatgttgcagctaagctaatgaccttaagtggcaattgtttaacccaggactactgatttttttatattcaagtcagtttcatcgttttacttaactcgccatataaccaaaaataacgaataatctaaaggaa

SEQ ID NO: 9388 - DNA, 4582 bp, Homo sapiens
gccgccgctgcccggagcctgggctcggctacccccccgccggcccccaccgagcggagctctgcttcctcctcgccgcatccctgagggaagcgccgcctctgctcccgggttctccgcccgccgactccttcctggccggaccccgctgcgctccaccccagtggctggaggagcagctctccagtcagcctttgcagcccctctctttttccctttccaccgggcctcctcggatcccttggctgggcactgaggcgggggaagaggctggggtcgccacggcggaggttgctgccgccacccccctgcgggggtggccggggttcccggctgggggggtaccgttctgggtgaggcatccaccatggtgaggcccctgtgccgtgcccccgcgcccccccggccgccgctgcctcctgcccctcggtgctgctgttgctcccccgcctgctgttgctcctccatctccagatcggatcacggtgagggaaacgatgagcgaggagacggcgacttctgacaacgataatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtggttttggaatgtatgcttaaaaaagacctcatttataataaggtcactccaacatttcaccactggaagattgatgacaaaaagtttggtcttacgtttcaaagtcctgctgatgctaggggcttttgatagaggtatccgaagagctatagaggatatttctcaaggatgccccgaatcaaaaaatgaagctgaaggggcagatgacttacaagcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcagataacatttggtcagccaggcttggacattcagagcagaagtatggaatacgtacagcggcaaatatccaaggaatgtggaagcctaaagtcccaaaatagggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaagttaagttcacccaaagactctgtggtatttaagacgcagccttcctcattaaaaattaagaagtcaaaacgaagaaaagaggatggtgaacgttctcgctgcgtatactgccaggaaaggtttaatcatgaagaaaatgtcaggggaaaatgtcaggatgctccagaccctattaaaagatgcatatatcaagttagttgcatgctctgtgcagagagcatgttgtatcattgtatgtcagactcagagggagatttttctgatccctgttcgtgtgacactagcgacgacaagttctgcttgcgatggttagccctggtagctttgtctttcattgtaccatgtatgtgctgctacgtccctttgagaatgtgccatcgctgtggtgaggcatgtggttgctgtggtgggaaacataaagctgctggatgaaatggtccagtgccaaaatgagcttaaaatctttgtttccaggaattagctaacttggatttgtggaagcttttggcaagcaatatggaatcttgcctggtatcattgagcccacacatggaggaagcagaactcatcagttcttggcgtttcacgccatgcctaacttttcccttgagtgcatggcatgttttgttacaggttgtagagtatttgcagaaggaaaccatttctggttatttggctataaaaagtcagcataaaatatgatccaactaaaagggattaatttttggcatttttgtatatttatgcattaggtgatgggacttttaaaggtttgaatttattaggacacgaactaaaaataaaagtgcactaggggacagttgatttcaatctaagaaaagttaacacttgggaattacaagaagtaaaacaagtgcaactaaatcatttattagttgttttttgaaagcagttttatgtataaataacaaatgtttatatttaactaaatgtaaggtacgaattattacatattaaacttttcttccccttcctagttctgaagtagatatatatatatatatatctactgtcacattccatatattttgaatatttaactcatctagttaataatgtttttattccatgcgaatgatttgatattttcatccttatttctctttggctacaatttatattgagttatatctgtacattctggtaatctaaaatccttaaaaatactctaatagccttgagtgaccaactttttttttaaagcacagatgtaattgtctaatgttctgatgggaacgtaacacttatttttatataaaaagagactgagtaaacaaacattatagaaaaaaagtgaagttttttagttgttttttgtggtattcaaccagcaagttgttttctttcagagtttcctccttcaaaaagttatattgcatttacaaatgttttacaaggcagaaagtttgactggatagttagtgtaaaagcttcatgttgagatcttcacgtatcattctgctaaaccagaatatgttcagctgtgttactaatttttcagcttaatcctcagtgcttattatttacataacaataactttttatcagttacattttatttttatttaaactggccaaaagcaaaattattttatgttaaaatgtgtgctaaactatcccaggaaagtatttaatccaacattgtaaatgaagtatcttgtacatataaatttatttcttttgcagagcattatattactggatgtttaatttacaaaatagttgggtaaatgttccaacaaactttaaagtaccttgaagtcaaattgtctgtttttgttttgttgttgttgttgttgttttcttaagtgttacattaaaactctaaccaaggaaagggttctttaagaacattcccttagagggataaagttgagaagtgtgccttttttttaatggcttgaagtttcagaggtgataaaaattaaaatcacactactatttgaagctcattttctatgcaggtttttaaacgtcatttatgtatcattctttttatatatcacacttaagcttgtgttagcttttttcttttgccccagatcaaactgaacaatgtatatacactatctgtctgtaaaatactttttttaagaaagcatttatatttatatgacagcttgaactgacaacattgtgtatatagatcatcttgaagtattatttcacattgaaaagaagaaaatatattgataactatagatgttatgaagaagagggtatttctagttttgtactaaaaatcaattggatgaactaaatccaaaacatgacactgtaggcagcagttttaagtcttatttttactgtttatatatttgaatgctgctacaacagatgatcttcatccctgaagttttcagctaaacttggtttcctagaatagactgttaactttcaaaatttttattggtgaaatggaaatactgtttttccttgtgaatgaattttcatatttgtaagtgctaagtttataattcaggtttgatcaaggtgtgaataactgaagaaaataacttgctggctatataggaaaatgctgtggaaatgaactgtgtatatacttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcttcattaaaaactatggcaaaaaaaaaaaaaaaaaaaaaaaaacaaacaatgtgtgggggcacgcccgctgggaccactggaaaaagagctttcctaaacaccaatctcggttggggggcgcggggccaccaggtgggggtacaagcggcacacgggcgccaaaaacgcgtgggtcccaagaggaaaaaccggggacacgcgaacagagggctgtgggatttttcaccaattataaaaaggcgccgcggggggggcacaaccgagggtgtgttcttgtagaagaaatttcccagagggggcggttcgagaaggggacacaaaacggggggtctctatttcacacgcgggggttgctcacgaggagaaggtcgaaatacttcacattc

SEQ ID NO: 9389 - DNA, 1769 bp, Homo sapiens
  misc_feature (1735)..(1735): n is a, c, g, or t
  misc_feature (1738)..(1738): n is a, c, g, or t
gccgccgctgcccggagcctgggctcggctacccccccgccggcccccaccgagcggagctctgcttcctcctcgccgcatccctgagggaagcgccgcctctgctcccgggttctccgcccgccgactccttcctggccggaccccgctgcgctccaccccagtggctggaggagcagctctccagtcagcctttgcagcccctctctttttccctttccaccgggcctcctcggatcccttggctgggcactgaggcgggggaagaggctggggtcgccacggcggaggttgctgccgccacccccctgcgggggtggccggggttcccggctgggggggtaccgttctgggtgaggcatccaccatggtgaggcccctgtgccgtgcccccgcgcccccccggccgccgctgcctcctgcccctcggtgctgctgttgctcccccgcctgctgttgctcctccatctccagatcggatcacggtgagggaaacgatgagcgaggagacggcgacttctgacaacgataatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtggttttggaatgtatgcttaaaaaagacctcatttataataaggtcactccaacatttcaccactggaagattgatgacaaaaagtttggtcttacgtttcaaagtcctgctgatgctaggggcttttgatagaggtatccgaagagctatagaggatatttctcaaggatgccccgaatcaaaaaatgaagctgaaggggcagatgacttacaagcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcagataacatttggtcagccaggcttggacattcagagcagaagtatggaatacgtacagcggcaaatatccaaggaatgtggaagcctaaagtcccaaaatagggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaaaggtttttcagaatttgctttacattcttcacatcaagttaatacccacaaagacaaggtgatgctgtgttacccaagctagtttcgaactcctgggctcaagcaatccttctacttcgacctccccaaagtgctgagatgactggcatgagccaccgcacccggccaggactactactgaaacatgtttcccacaatgagattagtattctctcaaaattactggttctgttaacctggaaataatttataataaccaagatgctatgtgcaattaggaagaaaggaggacaaagaattccagaatattcagtattgaaatgtcaagactattnacnataaaatttaaattaaaatttaacttaaaaa

SEQ ID NO: 9390 - DNA, 2055 bp, Homo sapiens
  misc_feature (2)..(3): n is a, c, g, or t
gnncccgcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtaaaaaaaaga

SEQ ID NO: 9391 - DNA, 1267 bp, Homo sapiens
  misc_feature (2)..(3): n is a, c, g, or t
gnncccgcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccaggacgaggaacaagtgggacaccgggggttcctgttgggcatcccctgatgttgttggttggacgatgtccgatggctgacttggctgcgcctgcctatgcgcacgactgctggcctggctggcccacattagcttggcgggttaaggtcactggtgagccttgctttcgccctcgctggaggggggcccaagcgatgtgcagaaacaaccagggcgtcgactacagagacccaatcacaagacggagccaaccctcttgggccctgatagagaaagagagcatgtcaccaaagaagtgacccgacaaaaataggcaccagcaaacacccaatgtggacgagcgaacacaacttagcagcacccacacaacgagagcagaaagacagcacgcgacccagcacagcgctacagtagacaacaaaaccatccgcagtcagagacacacagcagtagctacaccactcctagtcgatatagcagcgctcatgacgacaaa

SEQ ID NO: 9392 - DNA, 1905 bp, Homo sapiens
  misc_feature (2)..(3): n is a, c, g, or t
gnncccgcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtaaaaaaaaga

SEQ ID NO: 9393 - DNA, 1840 bp, Homo sapiens
gcggggaggaggtagaggcggagagctgcagacctaccgctgacttacgatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtaaaaaaaaga

SEQ ID NO: 9394 - DNA, 2198 bp, Homo sapiens
  misc_feature (2)..(3): n is a, c, g, or t
gnncccgcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtaaaaaaaagacttcagtcatcccagcaatcgcttggttcagtttcattcagctctctatggaccagtaatctgataaataaccgagctcttctttggggatcactacttcttgacttgtagtaactgccaccaatcaagcagtctctcccctg

SEQ ID NO: 9395 - DNA, 1999 bp, Homo sapiens
atttgtcctcggctcttatcagccctttaggcctgggaagacgtttcaggtttctatttcgcatagaagaaaccgaggtctaggcagaggaggccaccagcaccctaaaggcacctgctgcagggaaatggaagaattttcgccctagggggcacctctagaagcccgggaactaggcatctcctggatgtgcaggccaaaatgacagatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtaaaaaaaaga

SEQ ID NO: 9396 - DNA, 1933 bp, Homo sapiens
  misc_feature (2)..(3): n is a, c, g, or t
gnncccgcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcagatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtaaaaaaaaga

SEQ ID NO: 9397 - DNA, 2360 bp, Homo sapiens
  misc_feature (2)..(3): n is a, c, g, or t
gnncccgcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaaggtgaggggcttctcagctgccttgacagaggaactgggggcctgtccagaatgtactgtggtgccaggacctcagcctgtgagtcaccatctgaggggggaagggggaagaagagaccagaaaattgatggaagctaggaggacatccttgcttcatacacctaaccctacatacttggtgacaccatttgcccttgaggagctagctgccaagcaggtggttcaagctgggtggccccagtgggcctgacctccctgcacccccagccccttgagtgtctctctctcatggcctcccccaacagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgtaaaaaaaaga

SEQ ID NO: 9398 - DNA, 1885 bp, Homo sapiens
  misc_feature (2)..(3): n is a, c, g, or t
gnncccgcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccgatgtaccccagagctggccctcctgcctctgtcatggcctcatcagtttcctggggttcttgctgctgttggtcaccttccccatttctggctggtttgccctgaagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctgctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggatctcaatctctttactaaatttattttataaatttagtaatatataccatcattataaaaatcatctttaactctatgtaaacactatcaattgttcttgagcatatttgactgttaattttccatgatcatta

SEQ ID NO: 9399 - DNA, 567 bp, Homo sapiens
gatctttttttcccagtgacattaagaaaatctgaataacctttatgtgtagttatgcttgctataagttaaaacttgtaagttatgcttaagttaaaactgctttaaaaaaatctttactttgtaatgaaccacaccagttaaaataaactatactagttaaaagctgcctaaatatttgtcagaattgcaatttaaatctaaaaaagctattcataaatattctctagttacctatgtatattaaagtagatatttaaaataaaggatctgatctaagttcatattttttagacactgataggattcatattccaatcaaatcttaatgatttctcatcctaacatagcagaggccccatttcagcccacccaccactgaaaataaaggctttagaataactttctgtgcaacaagaggataactttctgtacttaaaatcagcttactaggaatttcacaagtaacacaggaacttccattgcacttgaaaagtaactgtgatggagcaattacagtaagaattttgatgttcagcgccacccagcgacagatctctgagtata

SEQ ID NO: 9400 - DNA, 642 bp, Homo sapiens
tcctgctctgtcaggcagcctctgccctcagctgccttcctctgaatctatccacccatcaccctgtggcttagcaattacactaactatgcaaatgtttttttagatatattctctcttgatgcctaaaaacaaagtcaaaaaaaattttaaacatcctggaaacctgaagagcaaaatgcaactataaataaatggttgtggcttccttaaagtccttaaggaatcaatgtgtaacctgagtccttgtttaatgggtgaaatttaaaaacataatgtataggcaaaaagctaaaacactggttggttgaatttactattaaactttgtttaactcttgctggaaataaacttagaactgctgaattttacagctttcaacgtttatgtttttcactagttcacaagagatgtctgaacaaaccatcagccttttttaagtaaaaaaaagatgttttctggatagtgtcactcagtatgtcaagcaaatcttgcaagggctagttttcaaaagaaaaaagagctgctaatgtatctggcatttctgcttcttccatcacctcaagtttatcatcttcatgtccacactgcggtcttctctggaataaggcagagctatacgttaggattaacagattttct

SEQ ID NO: 9401 - DNA, 332 bp, Homo sapiens
gttattacttgtaatgattcaaattctgccaatacttccaaaatcaaccaacaaaacctcagttaagccagatttggacggcatcttgcccatctctcactgactgactaaggattaaggcctgagtatttactactgcttaaaaaccacatcaatagtccgtccatcttgtttcctctagctatttttgcagatgtcaccagaaggctccaatgatgggtacacaaaccatacctggcttgtcatctgcttcatctctagtatctctgggagttataagacctttcagatttcagtttagcccaccacccacccccgacccccccaaggct

SEQ ID NO: 9402 - DNA, 138 bp, Homo sapiens
tagttctttattagagcaaatatatcattttatgcaatgatatgcttgttttaccttcttctgtccatcatgataaatatgaaattttatctctgaaaatatagggatcgtcatgctaacttgaggaaatgaaaagaa

SEQ ID NO: 9403 - DNA, 613 bp, Homo sapiens
gtagcatgaggaggctttgtgggacgatggggctgttctgtgccctaaccaaggtggagttttatgcgtctatacatgtattaaaattcatggaactgtaaactaaaaagaaacctattttactataacaattttttaattgtgtaaaaggaggaatgacttaggtttttttcaaacaattttttctctcccctaagaaaactcccaccctcagctgttagaagctcaccttttcttctccccacattagcttctccttcagcgtctataagggaaccactggcctatctagaggagaaccgatatggcccctatggcctcctgggatgccgcagaagcaaatctcctttcgtacattcacattcacaggctgcctctgaagataggaagggcttgcttagttggacccttttaaagaagttttgcagttcactttcctgggctagtggaaagacgagatagttaggcctcggaacccagaattcactcttgcccctgacatggaattgggatcatggctcactgccttggcctgggagaaatttcaagccaggtcagagggaaggactgcaccaggacaggctgttggggctggagggacccggaaaaaaag

SEQ ID NO: 9404 - DNA, 447 bp, Homo sapiens
gcctcccaaagttctgggattacagacatgagccactgtgcctggctgttaacagtctacacatttaaccttctgcacggtcagatccaaaggggaaaaacctcatgagttgtgatgagttgtttggggaagtggcacgggcagaccactcactgtagagggcccagcatatcacagaggactgaaagggccaaggcgagggagaggttggggggaaatgtgttacacaccaatggcccaactctggtgagcctacgcctcttctggtaccaccagcaggaaggcaccatcctttccctgcaaataatgttttagaaatttcctggctggtgtggtggctcactcctgtaatcccagcactttgggaggctggggcaggaggatcacttgaggccaggagttcaagaccagcctgggcaacacgatgagacccccgtcactaccaaa

SEQ ID NO: 9405 - DNA, 454 bp, Homo sapiens
ttgctaaatattttcaacacactttataacataggcataagttatcaatcctatagtcttttccagttctaaaaatcccataagattcctagaattaccctaaatgagaaattagtttaggtttaatggcatatgtattttatctctttaaataatgtaacctaatataactgcccgactttttatttgtgctaaaatacatgtaacataaaattgaccactgtaaccattttaaagtgtataattcagtggcactaagttcattcacaatgatctgcagccaccactatctagtccagaactttctcatcaccccaaatggaaacccagcacctattaggcagtcacgctccattattccctccccccagttccaggcaaccacgaatctgctttctgtctctatggatttacctattataaataaaaccatataatgggtggtctttcgtgt

SEQ ID NO: 9406 - DNA, 726 bp, Homo sapiens
aaccctttttagcttcctcacacaattacatgcttgctacatcttctttcatttgcccagttatcttgggcctgtaaggtcctgtacttgaccctattttatatatgtttttattagtgacttagaaaatgacagtaggccaggtgtggtagctcacgcctgtaatcctaggcaggaggattcctagagcccaggagtttgagatccacctgggtaacatcgggagacccggtttctatttaaaacaaacaaacaaaaaattaaaaataaaaaaaataaaatgacagcaaacatttataagcttgtgcataaaacaaacagttaaaatactagatgacagaacagagattgaagcgaggcaaacgggtatgtaaaacaagacttatttttttttttgagacggagtctcactctgtcgcccaggctggagtgcactggcacgatcttggctcacttgcaagctatgcctccagggtttgcaccattctcctgcctcagcctcccgagtagctaggactacaggtgcccgccaccacgcctggctaattttttttttcttttttttagtagagacggggtttcaccgtgttagccagaatggtctcaatctcctgacctcgttatctgcccgccttggcctcccaaagtgctgggattacaggcgtgagccaccgcgcccggccaacaagatgaattttaaaaggacttcgtacaaagttttgcctt

SEQ ID NO: 9407 - DNA, 1023 bp, Homo sapiens
gatccctaactaaactctgcagtgtcccacgaagtcctggtgcagagcattaaaaataatcatttcataaacttctttcaggaaccttggtagaggtggtggatgctacctaccctgatgctgtctctaattagagaggtttgtaaagattcctttgttgcaaagtgtaacacagtgttatttcctcatgagaaatttattggctcatctacatgaagttttttctaagctttcccttaagaactaattgtattaaattattaccatgttgtgttttaatctcattgttcatcctttctaaaaagaaatgctcagataagttgagagtaaggttaaatatatgagcagttaagtactcatacatgattacagcattctaagagttcaaaccttaaaaattatcagtgctagaaatcgacaaatatattcaagtatacaaacattcaacagatatataaacttagtatccctctacatgctgatatattttcaaataatgtgctttcttttcattgaactgtggtatgatgagaataacatgtcctcgggaattagagaacttagtttgagactatggatttctcaatcatgattttgggtaaaaaaattagctgctttatgtctcagttttgctatgtgtgaaaggaatggctgggatgataattgttagtattccttttagtttccaattcatatggtcctattatataaatatttagcttaatattgggaaactagttttataaaactattatatcttttggaatatattctgtttatttttggatatatatatatatatatactgtatctgtggctttacaaagaatataacactatcagtattattttcaacttgttgaattatgtgaaatttatcctttaaatggaactgtgctttagttttacaggataaattttagtattttaatatcagaaggaagctatacttagtaacgtatttgctactttatagtgaatagtaaaagacattaataaaatttctttttcatgatgctctta

SEQ ID NO: 9408 - DNA, 1134 bp, Homo sapiens
gatccctaactaaactctgcagtgtcccacgaagtcctggtgcagagcattaaaaataatcatttcataaacttctttcaggaaccttggtagaggtggtggatgctacctaccctgatgctgtctctaattagagaggtttgtaaagattcctttgttgcaaagtgtaacacagtgttatttcctcatgagaaatttattggctcatctacatgaagttttttctaagctttcccttaagaactaattgtattaaattattaccatgttgtgttttaatctcattgttcatcctttctaaaaagaaatgctcagataagttgagagtaaggttaaatatatgagcagttaagtactcatacatgattacagcattctaagagttcaaaccttaaaaattatcagtgctagaaatcgacaaatatattcaagtatacaaacattcaacagatatataaacttagtatccctctacatgctgatatattttcaaataatgtgctttcttttcattgaactgtggtatgatgagaataacatgtcctcgggaattagagaacttagtttgagactatggatttctcaatcatgattttgggtaaaaaaattagctgctttatgtctcagttttgctatgtgtgaaaggaatggctgggatgataattgttagtattccttttagtttccaattcatatggtcctattatataaatatttagcttaatattgggaaactagttttataaaactattatatcttttggaatatattctgtttatttttggatatatatatatatatatactgtatctgtggctttacaaagaatataacactatcagtattattttcaacttgttgaattatgtgaaatttatcctttaaatggaactgtgctttagttttacaggataaattttagtattttaatatcagaaggaagctatacttagtaacgtatttgctactttatagtgaatagtaaaagacattaataaaatttctttttcatgatgctcttaattgcatggcattaaattattttgttttgaaataagtatagcagtctattataatatatggagatcattccaagtccattcaaaatacatttaaatcctcgagaaaaaaat

SEQ ID NO: 9409 - DNA, 342 bp, Homo sapiens
gcctcccgggatcaagcaattctctgcctcagcctcctgagtagctgggattacaggcgcccgccaccaggtccggctgattgttttgtatttttagtagagatggggtttcaccatcttggccaggatggtctttaactcctgacctcgtgatccacccacctcagcctcccaaagtgctgggattataggcgtaaactaccacgcccggcctcccagggtagcttttgtagctgacattttttgacagcagagccgctctaacgctgtgtagattattctctggggacatgctgatccgcatcctggatactaatcaacatggtttgggaacgcctaaac

SEQ ID NO: 9410 - DNA, 367 bp, Homo sapiens
gatcacaaggtcccacaataggccatttgcaggctgaggagcaaggacagccagtctgagttctaaaactgaagaacttggagtccaatgtttgagggcaggaagcatccagcatgggagaaagacgtaggctgggaggctagggctgtctctctttttcacatttttctgcttgccaccctggcagctggttagattgtgcccacccagattaaggaccggtctgcctttcccagcccactgactcaatgttaatctcctttggcaacacccttgcagacacacctgggatcagtactttgcatctgtcaatccagtcaagttgacactcagtattaaccatcacacagagggagaccctgtctca

SEQ ID NO: 9411 - DNA, 770 bp, Homo sapiens
attgatggggcaagccatgggactggaaggcagcaggcagatgtcagggttggggattactggctcagaagcaggtatcatagcagaagcccaagtctcttccaagtcacagggctaggaaccaagatatcagcaggggaagcagggggtggagggggtataaaaatgacccaactacaaccaccaatactaccatttactgaggcttcgccatgcagcaggcaccctgaaaagtgttttgtttgcattatcttagtcagtcctcctagcagcctgattagtagaagttgttacagaaacacagatgaaaccatgggttagaaagaggttgagtgctagagaatcttatggctgcaaaatgagtaagcagagacttcaaccactgtcttctgactcacagcccaagggaaagaccaggcaagagtaggagtgaagtttctttttctccccagggtcatgggatacatgaacttcaggcttaatctctgtgtgagaaaaacagcatgaagataatcaactctatgtcagaagaaattggcaacactactaaccacgagtaatgcacaccgaaggaggacccggggaagaaccaagagaagacaagaactgaagttcttccattcccacctctgcatcaccttccctgctttctctttccccagaagagactcagtcaacatcccaaagaccaatgatttcattgttttacaccaaatatccctcctctaaatttttcaagaaattgggaataaacttcttacgcaagaaaa

SEQ ID NO: 9412 - DNA, 476 bp, Homo sapiens
attgatggggcaagccatgggactggaaggcagcaggcagatgtcagggttggggattactggctcagaagcaggaaatctcatgtagaagcccagaactttcaagagataagaagtagagagattctggtttaaagagagatgacagaagccctgaatgtcctctcttctgctcccccagataccttcatggactacagggctgtacatacggttagactccttgacctcaatggtcatgggatacatgaacttcaggcttaatctctgtgtgagaaaaacagcatgaagataatcaactctatgtcagaagaaattggcaacactactaaccacgagtaatgcacaccgaagggttgtgaagaggacgttactatttgtacactgttttgagcagtgcctgctgtacagtaaggaccatatatgtgtttataaaataaatcttagttgctataggcaacaccacgcagctgaga

SEQ ID NO: 9413 - DNA, 891 bp, Homo sapiens
attgatggggcaagccatgggactggaaggcagcaggcagatgtcagggttggggattactggctcagaagcaggtatcatagcagaagcccaagtctcttccaagtcacagggctaggaaccaagatatcagcaggggaagcagggggtggagggggtataaaaatgacccaactacaaccaccaatactaccatttactgaggcttcgccatgcagcaggcaccctgaaaagtgttttgtttgcattatcttagtcagtcctcctagcagcctgattagtagaagttgttacagaaacacagatgaaaccatgggttagaaagaggttgagtgctagagaatcttatggctgcaaaatgagtaagcagagacttcaaccactgtcttctgactcacagcccaagggaaagaccaggcaagagtaggagtgaagaaatctcatgtagaagcccagaactttcaagagataagaagtagagagattctggtttaaagagagatgacagaagccctgaatgtcctctcttctgctcccccagataccttcatggactacagggctgtacatacgggtcatgggatacatgaacttcaggcttaatctctgtgtgagaaaaacagcatgaagataatcaactctatgtcagaagaaattggcaacactactaaccacgagtaatgcacaccgaaggaggacccggggaagaaccaagagaagacaagaactgaagttcttccattcccacctctgcatcaccttccctgctttctctttccccagaagagactcagtcaacatcccaaagaccaatgatttcattgttttacaccaaatatccctcctctaaatttttcaagaaattgggaataaacttcttacgcaagaaaa

SEQ ID NO: 9414 - DNA, 714 bp, Homo sapiens
attgatggggcaagccatgggactggaaggcagcaggcagatgtcagggttggggattactggctcagaagcaggtatcatagcagaagcccaagtctcttccaagtcacagggctaggaaccaagatatcagcaggggaagcagggggtggagggggtataaaaatgacccaactacaaccaccaatactaccatttactgaggcttcgccatgcagcaggcaccctgaaaagtgttttgtttgcattatcttagtcagtcctcctagcagcctgattagtagaagttgttacagaaacacagatgaaaccatgggttagaaagaggttgagtgctagagaatcttatggctgcaaaatgagtaagcagagacttcaaccactgtcttctgactcacagcccaagggaaagaccaggcaagagtaggagtgaagaaatctcatgtagaagcccagaactttcaagagataagaagtagagagattctggtttaaagagagatgacagaagccctgaatgtcctctcttctgctcccccagataccttcatggactacagggctgtacatacggttagactccttgacctcaatgtgaatgtctaaagactccaagcatcctaactccaattagaaatccagcagcaatgtattaccatgcagttgtctaaaaccttaaaaaaaaaagctatttaaattgtccatcttttcaca

SEQ ID NO: 9415 - DNA, 492 bp, Homo sapiens
cttgctgagagatcttttgtctctgtgctgacttttcttcacggcactgattatctttttctaacaattttggtggcaattgtatggggatatactttcctccaggggcgtctctagtcctctctcacgagggggcactctgctgcctcttgcagtggcctcaggggtaagggaccgagacccatccggtgtgaccaataaacccggactctcagcaatgtggaaagaaactggccaacaacctggggtaaaggatcctcacataccgaggtgacgactctgtgcacagaccaacgaaggagaagccacgggagccggtgttatgtcgtaccatacatccaggagttcatcaaaacaactaagccaagacatgctaagaaagtttgaagaggaaaactatacagtaaaagaggagggaattgtaggaagtaaaaagtttctgcttcaaagttccccttcttgttaaagaataaatcataagtcttagaaata

SEQ ID NO: 9416 - DNA, 339 bp, Homo sapiens
caactcatatggtttccctaagagaaggagatggcataaataaatctcagaaaaacaagacaaaagatgtggggacatctttgactattatcttcatcttcaatttagttatagatccccatggtgcctgatgattaacttctactccacatggtgctgtgctgggttggtactaagataactccgtaatggcttcaagtaataattgggaatatgagatttaacagatttgaaataataatgggagatagaagaagaagatatgaaaatttagttagaggaaagtttcgagaagttaaaaataaaagagacatagcattgagaacagggagaatttag

SEQ ID NO: 9417 - DNA, 704 bp, Homo sapiens
tttgcttctcattccccatcatcgtggctccgtggcatacattaaatcaaaccatgacctccatacattaaatcaaaccatgacctccgaatcttcttagttattttcaggtacaaggttttcagcttcagaaaggacagaggtctccatggttccattttgaagatttttgggtggctactgcttgtttaccagcagtttggtatagaagcccaagacagtccatgtgtggttcagtattgacctaatagcagaataaatttggaccaaacagaagtccttttctttgtcactgtgtttgattaactatcctggatatgctttattctctaaaaacttcatttttgaaaataccatggttattaaacaactagtctttgtgcgtgattaggacataaacaggaatctcacccacttttaaacctttccaagaaataacttttccactgattttattttgaattgttaaaaaacttttagcagggagagaaaatttggttgatgattcagagcgcgagggaaaggaagcaagggattctggcacatgcgcacgagttgaatgacaactggtggatatttttatatttattgctattcttagcctaaggctggagctgagtagggagtaactaagcttagccatacttattagacttagagattttactttgtttatgtcaatgtcaaggcctttgggaaaactt

SEQ ID NO: 9418 - DNA, 424 bp, Homo sapiens
aagcaaatcagaccaagaaaaagatgggactgggctctgttttcaccttccctcggggtgccaggcacaaatgagaggcgagttcaatacccatgcattgctctctcctatgaaaaatagatttcccatgaagtcagggcactctccctctgactcctgccctttcagagcatgctctgcctcctctggttgactctttgctgctgtaaaaaggcttcactcatccatagggctgtgagttggcagcagagagaggatgctgaggggtgagggctgggggtgtgcagggagatgacacatttcaggtaaatcgctgtcagagacgtggcattttcattcatagccttgtcagagtaacctttgggtgaaagggggagaattgtcttctcccacctaagaggttgccattcatgttttaatttgc

SEQ ID NO: 9419 - DNA, 407 bp, Homo sapiens
gactctcacaatatgtctaatattatgtgaaacactatgctctttgaagcgatttcacattaataaactaacattttcatcacacagattatttaagtaatgtaaaatattattatgagtatataacagaaaaacagagttagggaagaaatccacctaaaatgatgaggggttaatagattttgactctacactattaccaggtctctaatgaagtgtcccaaaatttgtgtctttttagaatacataacaaattatattatttgtacaagacactgaagtaaaatgaccaaggtgttcctaagccacaagctacaagcactgacctgctactccagccttgccctctcaaagagcaaagatgttaatacctggtctcagtaataaagttgggtaaaatttaaaca

SEQ ID NO: 9420 - DNA, 328 bp, Homo sapiens
tctatatctgtgctacccaatacagtttagtgtcttgctgcatatagctattgagctcttcagatttggctagaggaagtgacttttcacatttaactgatttaaatttcaatagccatgtgtgatctgtgactaccatgttaggcagcacagctttatgagattaatattgtagaatcatgtgacaaaaagcagcattgtgagagaacagttacgtgaaaatataaggaagcatagagctcatggggttgagccagtcagaatcgcatttttaattagtcatggacactactcttattatgtcctttattgtacaaacaaaaaaata

SEQ ID NO: 9421 - DNA, 377 bp, Homo sapiens
agagaagtcatccagggcagtgccagcagtacagacggccggctgccttctcagcagcagagaaagccagaagactgtggtgttcatcttcaatattgagagaaggaacctattgagtatccaacaaaattatcttttaacatcaaaggtgaaatgacattttcagataaaacagagtttactaccaacagaccatcattaaagatgcttctaaaagacaggattcaggaagaaggaaaaatgttttaaaaggaaagaatgagctgggcgtggtgggtcatgcctgttatcgcagcactttgagaggctgaggaaggaggattacttgaggccaggagttcaagaccagcctaagcaacatagcaagacccctctct

SEQ ID NO: 9422 - DNA, 130 bp, Homo sapiens
ttagcaaattagaaattacattgaaatatagagttttctttttgatttataaaactatcagtaactttcatctgaagtggagtatttcttgcttaaggttttctgtttgagatttaaaatagtagactta

SEQ ID NO: 9423 - DNA, 490 bp, Homo sapiens
tcacaatcaccaatttagaaaaacataaaaatatttgcaggccatatttatttatgtttatataactgcatactttaaaaaaaagcagcaagtgcagtcttggtaactaaggtctcactctccagttagaaaaacagaaaaagcactattgtttctagatttaactctgagcctcttaagttttgttgtgggggaaaacactttttaagctagggtcattccccgttccctgactagcttttccacccactcaaattatcaaatgtggttttgtctcagagtgtgcctgttaatattgtatactttaaaacaagagatcccctgctgatttccggtgtgggacatataggggacatgagggacacagagggtggggctcctcttaccacttactgtgaaggcacatggttttcattagccctttttatcttcttgggagggcaactgagttttaggctttcctttagggggaatggtctgcccacgctta

SEQ ID NO: 9424 - DNA, 491 bp, Homo sapiens
ggatttcatactccttaaaaatagctgcttcaggctgggcatggtggctcatgtctgcagtaccagagctttgcaaggcctggggcaggaggatctcttgaggccagaagttcaagagcagcctgggcaacatggtgagaaccccatctctaaaaaatagaagaaataaattagctgggtgtggtggcttgcttctatagtcccagctacttgggaggctgaggagggaggatcgcttgggcttgggaggtcgaggctgcagtgagctaatatcacactgctgtactccagcctgggcaagagagtgagatcctgtctctattttttgtttttaaaaatagctgcttcagtaaggcacaagtgtatatctgtataacaagatttctaagactataaaggcaagccaaactaattgtcttgctgcctcaaaattttatcattgactctccataaataatagtaaagccagaagtagatacacatgtgttaaa

SEQ ID NO: 9425 - DNA, 444 bp, Homo sapiens
tatactctagtaaaaaaggccatctaaagaatgaggcaaattacacgatacaaaatgctatgcaagatgtaatggataaaagagaaaagaagatgctttttaaaaagcaaatatgctgtgaccctgctatgtagaacagtcaaaaaattctgggtattatctgtgtttgcacacagtaaaaatgttaacaatgggtacctactggatggagactcggatcgctgggacagaggaattttacttttttacttaaaaaagccaaaaccaggaaaggtaatatttgcacgttaccgattctaacaataagaatgtacagtagactgggcacggtggctcacagctgtaatcccagcactttgggaggccagggcgggtggaatcacgaggtgaagagttcaagaccagcatggccaacatgatgaaaccctgtctctactaaaaata

SEQ ID NO: 9426 - DNA, 735 bp, Homo sapiens
ttcactacatgaatacacagactacccattttatcttagtctacttctttcttctctctttgggcctgaataaagaccagaactgatagacagctaaaggatattgcaagcatcattattggaattgggagattccacagaacaatctgagaatgatctcatatcaaatccaatcagatgagttattctgagactaattccaatagttctagagacttttttttttatggtggacattgtttttattgtgtaaataagcaatttttaaagtatatttaaagaaatgaaacataaggaagtgtataggctgtcaggtatgtggggaagtgaagttcatgtagttttcatgtggagcccatacagattttattatagtcaattttagtgaaatttatcgttggtcagatgaaggtttttttccttcattcagcaaataactaatgactgcctactatgtgctaggtgccgaagatagagagataaataacacttagtcactctaagctgaaattgctcagcatatgaaagtggaggaatatttgtaggtgattttgatgttaaagtatttttttaacatcacctggtagtagaagattgagttatgaagctgtctacctctcacctgtaatagttttagagttggttgctattttggtgtaagtcttttttgctgttcctcttttaactgcaaatctttttgagaccagcactcacatccaaaagggcaattgtgat

SEQ ID NO: 9427 - DNA, 816 bp, Homo sapiens
tcccaaagtgctgggattacaggcgtgagccaccgcacccggccgaaaatgtacaatttttaagtacacatgtgcatacctgtgaaaccatcacacaatcaacataatgaacatattcatctccctgcaagcatcctgctgccctttataatcattccaactctcccacctcccatcctctagtaaccactgacctgtgtagattagttggcattttatagaattatatgtaagtgcaatcaaacagtatgtactcctttagtttttgattttttcacttgccatgctattcagagattcatccatgtcactgtgtgtatcaatagttctttccttttattgccacatagtgttcctttatatgaatctactacaatttttttatccatttacctgttgatactgggttgtttctcatttttggggctataacaaaagtgccatgaagatttgtgtatgattctttgtgtggagatatgttctcatttctcttgggtaaatacctaggagtgaaagagctaggtcatatgataggtatatatttaactttttaagaaactgctaactgttctccgaagtgcttgtaccattttccatttccacaaacagtgtatgtgagttctttcttccacatgcttgttaacatgtggtatagtcagtccttttattccagtggtatgaaatgattatctcattgtggttcttttttgaacctttgttgtgactgatgatgttgggcatcttatgtctttatctgccatttgtgtatctgtagcttctttcgtgaagtgtgttcaaatattttgtccatttaaa

SEQ ID NO: 9428 - DNA, 437 bp, Homo sapiens
cacacatatgtatttatgtgttgtgtatacatatgtctgtgcatgtatatgcatatacacacatatatacatacattacatacatacacacatatgcatactttttcccactgaagttgttgaaactcttgaaagttggacttgagtaatcaaaagcagtgcttattcttttccattcagtaccaaggaaatcatatttaccacgggtccagaaaagtcttttctctctttctcctccccactacccaccagtccccactccttttgcacatgctatttggtcactggccatcccgagtggctcatctagacaggggtatgtggccaggagaggttaggggtcgagataaggtggatgtttgctgtaaggcagtgccttcctctccttcttaacctggggttgtgcttctgagcatgtgaaatgtattgttccttag

SEQ ID NO: 9429 - DNA, 678 bp, Homo sapiens
acccctgggcagaattgagcagattgaagattgctagtcagctgatgggttggctcccttgagccaagtgctcacctctggtttagtgtgtggccacttccgtggagagaagacggaattttctctttctggggagttgtaggcaggcagttgaagctagaaggagctggccatgtcgggcaaatggactgaccgcagaactggccacagaagtgtcagcttgattggggtcagggattagagggaaggagataatggtggatgtggatatagatgactctgtacgtgccaaggaggaggctgagggacagcaaggggatactgggggagaccccacctcaattcccccatcaccttgatttcctcactgcacaggaggaaggaccctctgctaaatgtggcgagaatggtagtgcagagaggactgaccttgggggaaacaagtacaaccaggagaggatacaaatagagtatgtggaggtgctgtttgcagatttctttagtaagcattcaagtcttcataatcttttataactgagagccaattaaagaaaggtctgtttgttttagtgaaaaatttcctcattttcagcagccatattcccctggaatcagcagaaagagaaagtaacattgcagggggaattggtaaaatgcaggagcacctataagaggcaa

SEQ ID NO: 9430 - DNA, 445 bp, Homo sapiens
ttctggatgaagttacatttgaactgacccttaaaaaaatgaagatgtaaccaaaacctgtgggatacagtaaaaacaatactaaaaaggaagttcatagcaataaatgcctacatagaaaaagaaaaacatcactaggtgcagtggcttacgcctgtaatcccagcactttgggaggccgaggcaggtggatcacctgagggaggtcaggaattcaagacccaagaccagcctggccaacatggtgaaaccccatctctactaaaaatacaaaaattagctgggcgtggtggcacacgcctataatcccagctactcgggaggctgaggcagaaaatcacttgaacccgggaggcagaggttgtagtgagccgagatcgcgtcactgcactccagcctgggtgacaagagcgaaactccatctcaaaaaaaataaaaaaataaa

SEQ ID NO: 9431 - DNA, 706 bp, Homo sapiens
catattaaatcttcagaccctggtaggtatttactcaccgcacacctcaactctggattagccacatatcaagtgctcacagccacacatactcatggctcatggttacagtgctgggcagtgcagctcgaaagcatgacaggcttttgctaaccacaagccttcagccacacagtcctttttcccttcccacctccttttcgttatccccctcttcatccagattcctcaaggtccaactcaagtagaacctcttgagaaaggcctatcccagcaactccagctcttaatgatcctgacgcactacaataaaactgaatgcaaactgtgggcaatgagtatgggaggcctattacagaaaaaagttcaagacagaaacactcaaggaattgaccttttcggattacaaatatgtataaatgtaatgctatcatttgtaataaagagacaaaataactaaatgtcggctgggctcagtggctcatgcctgtaatcccagcactttgggagatgggtggagcccttgagcccaggagttcaagttgcagtgagcagagatgacatcactgcactccagcctgggcaagagagtgagaccctgtctcaaaacaaagagaaagaaaaaaacaactaaatgtccattgatagaaaactagttaaataaatggtagatccacataacggaatattatagagctaaaagaat

SEQ ID NO: 9432 - DNA, 599 bp, Homo sapiens
  misc_feature (567)..(567): n is a, c, g, or t
  misc_feature (579)..(579): n is a, c, g, or t
catattaaatcttcagaccctggtaggtatttactcaccgcacacctcaactctggattagccacatatcaagtgctcacagccacacatactcatggctcatggttacagtgctgggcagtgcagctcgaaagcatgacaggcttttgctaaccacaagccttcagccacacagtcctttttcccttcccacctccttttcgttatccccctcttcatccagattcctcaaggtccaactcaagtagaacctcttgagaaaggcctatcccagcaactccagctcttaatgatcctgacgcactacaataaaactgaatgcaaactgtgggcaatgagtatgggaggcctattacagaaaaaagttcaagacagaaacactcaaggaattgaccttttcggattacaaatatgtataaatgtaatgctatcatttgtaataaagagacaaaataactaaatgtcggctgggctcagtggctcatgcctgtaatcccagcactttgggagatgggtggagcccttgagcccaggagttcaagaccagcctggggtctcattctatanggagaaacaaangtttaataggaaaaggagga

SEQ ID NO: 9433 - DNA, 299 bp, Homo sapiens
aatatggagtcactcatgctaaatgcaattaacttgggagtatactcctaagttgcaaaaagtggtaacaaatagctgagttttggggcagttacagcagctgagcatctgtcaatgtaggtggccaggtgattcaattaaggatgctgtaaccaattaagctgtatctacacctcacttctgttttctatctacaaatactgcgtgatcatgttgctggttggagttctttgaataagctgtggttcggagggatgcccaattctagaatcatgaataaaagcctattaagatcttta

SEQ ID NO: 9434 - DNA, 386 bp, Homo sapiens
gatagtagttttctattgctgcaccaatattaccacaaacttagtagctgaaaacaacacacatctattatttcacagtttctgtggatcagaagtccaggcacaactgagttctcttcaaagctgcaatcaaggtgttagcgagggttggggtctcagtctcataagaatgctcaactggggaaagatctgcttccaaatttatccaggttgttggcaaaattcaggtccttgctttcataggaccgagagcttcattttcctgctggctattggctacaggctgccctcagcttttagagaccaccctgagttccttttgggttgctgtaaaccaaaaataaaattctaagcccctcagccatctgaatggacccctcttcttg

SEQ ID NO: 9435 - DNA, 616 bp, Homo sapiens
acctgccttgggcctgaggggagcctactgcactgaagggtgagtctcaggcctgacagcattcaccacaagctgactgaagagcccttgggtcttaagtgaacagtggcagtagctgtgcagcactccccatgggtctgtggtaggagtaaaatggggtgagtctcctctgtggaaaggggaggaaagagtgggaaggattttgtcttttggttggagtgccaggttagccacagtagtatggagtaccaagtagatttttatgtgttttgactctagtctctggctcccagaccgcacttctggacccagggcctagggaaatgcaccatcctgaagggaagaacacaagcatggctggctttgccaccttctgattgtagagcgctaggaccttgagtgaacataggtggtagccacaaagttattacagtgggccttaagtgagacccagtgctatgtttcatgtctaaggcagtgcagttccagtgctggtggccacaggggtgcttggatcactgcaaagagagaaactccattcattggggaaaagtaagagaactgaaatctctgcctggtaatccaaggacttattctggatcttatctaagaccac

SEQ ID NO: 9436 - DNA, 780 bp, Homo sapiens
actggagaactgccttaaaaaacaaaacaaacaaacaaaaacagtgaaatacttaatggtttaaccagtcttcgtttttcctcatcttaaatattaaattcaacttagccatagttctagaaaaatggctagatatctcattcaccaatgaactctcaaatacagtgatgacacatcccatttctctcatttctagttctctacagtaaagtgaaggggccacttgtagaaagacaagcatgcttgagcactcacaaactgatgttcagaatctctgccaagtgagacactcaacagatgtaacctcagtgaaataactgtggccaacaatctagctaagaggctctaaaaccaggcattaaaagcagatccatggcggggcacggtggctcacatctgtaatcccagtatgttgggaggcttaggcaggaggatctcttgaggccaggagttcaacaccagcctgggcaacatagtgagtctctgtttctgttaaaaaaatgtttaagggctggcacggtggctcacacctgtaatccccagtactttgggagggtgaggcaggaggattacttaagtctaggatttcaagaccagcctgggcaacatggcaagaccctgtctctgtaaaattaaaaaattagccagacatagtggcacatgctggcgtcagctacgtaggaggctgaggtaggaggatttaactcaggaagtcgaggctgtagtgagctgtgtttgtgccactgcactgcagcctgggcaacaaagtgagtctgtttc

SEQ ID NO: 9437 - DNA, 414 bp, Homo sapiens
ccccagcccaccctggcccagccatcctgcacggaagcacaggctgtttgctgaattcaatccttgcctaaacatttgtttatttgagacaagatgcctgcggggcctcatggccaggtcagagctcacagctggggcagaggaggagaggctgcagaagactggacctgtaggtttgtctccaactctgagactccaggcggggagtcctggggtcagagcatggacagggctcatagtgttgggtcacagactcaagactctccaggtttcctcataaaaaggaaggaaacagccgtgcgcagttgtcacgcctgtaatcccagcactttgggaggcagaggcaggcagatcacttgacgtcaggagtttgagaccagtctggccaacaaggcaaaaccccatctctacaaa

SEQ ID NO: 9438 - DNA, 604 bp, Homo sapiens
cattattaactttattttagaagataatcaccccaaatgggttcagaccacaaattccaagttcctgcaagacttgtgtggattgtggttgctgtgagtctgtgagatgtggatctgtctcgcacaagcgccacctagtggccagcctgggactctggtggtaatctatcccacatttcagcactcaaagtctgtgtggtccgtgtagggtcggatccatacatgtagagctcaagggtaagcccaagagttcatgagcaactttcaggggttgctctcccgaagcccttcctcattgtaacctgcccagtagtgtctgggtccctgggctctaccttttcagccctccagccagcttgggtggttgaggcttgatttaccctactctctggtgcacttgactgaaccacgtcagagctaagcagcgagaagccagagagaaaaagcatgaaggtttccccaccctctggggacctcagactctctggttggaaaggaagtttgcctggcctgatgactttaattatctgccatttctcactagggccacaaaatttcttgaggtctggggcacagagaagaaaaaattttagaagaaaaagaa

SEQ ID NO: 9439 - DNA, 562 bp, Homo sapiens
caggaatattattcagccttgaaaggaaattcggacacgtgctacaacatagatgaatcttgaggacggtatgcaaagtgaaataaatcagacacagaaggacaaatactgtatgattccacttatataaagtacctagattagtcagattcatagagacaaagtagaatggtggttgctagacgctggagggaggggagaaaggggagttattaatgggtgtagagtttctgttacacaggatgcaaagtggcctgaagatggatggtcgtgatggttgcacagcaatgtgaatttaatgacactgaagtgtacacttaaaagtcattaaaatgctaaattttgtatgtgttttacaattttaaaaatggaaaaaaagtaagaccaaaagcaacacctctccagaatgtgtgttatataccaaattttgacgtatgtgagattgctgactatattttacttatcaatttgaaattatattgtttttatgttgacactccatataagccattattttgaaaaaaacattttccttattaaaagattggaaaaaaattcacaa

SEQ ID NO: 9440 - DNA, 324 bp, Homo sapiens
taaatccttaattagaactgattgagcatattataatgttcatgtggattttatgctactctctgtcatttttgaatttattaagcaaaccaatccttccttgatgtgatttccttgaaagcatttcttttatatctacttatagtagtgtcaactctttgttatgctatacctctttcagtgtggaagatacgattttaagttactcggcttccaaaatatattgctgtaaacgtacatattttcagactcagcatttttactagagttagtcttacctcaaaacttctattttacttaccattctgtttcagtttttatttt

SEQ ID NO: 9441 - DNA, 519 bp, Homo sapiens
gagcctttcaaggaggtactgttattgacatcatttttctagtgaggagcctgaggcttagattcagaaacctgtgagtcgccatatagctagtagctggccgagccatgatttgaacttagctgtgctcaaaaccaccacaccatgatacctcagagatgaatgtgtgcgtggtggttatgggagaagagaaccacatttacttattttttgtctgggtcttgcatggtgttttagatcatttcatttctgttatttcattttgaaacatttctactataattattatccatattttacatatagggaatctagtctcagaaaaactgaagcttataaccaatattttacagctagtgataatgagggagcagacatttgaacttgacaacctaaattcaggttctggctaggggtttcgttaaggaaaggaaaaattccctccaacaaaggtcatttttatgatgtgtaagtgatttaagctttctgtataccaccccaccccttacaaagatttgt

SEQ ID NO: 9442 - DNA, 1758 bp, Homo sapiens
caagcgctgttctatgaggccacaacctgacccaaaggaccccgcccccatcggccgcctaaactccagagcacgagcaagaaagtggagggccacgggctgcagcgtagccgagtttgaatactggttccatagctggctagctgtacgacctcgggcaagttatcacaaaacagggagaatcccggcacctaactcggaacggtcacaggctgagatgatattactgtgtgaagtgcgcagagcggtgttgggcacatggtcatcggaactatgttcgttatttttataagtatctttaagtggggggaatctgctccactaggcttccaggtacctaccgtccaagaaaggaagccaggaagtgcaaaccaacataattactatgaaaaacgtagtttctaagacctgtgtaactcttctagtgttctattacaagtagcccccagttatctcttgaaggaaactgtaaaacaatcttgccaatgagaaggacggacctggatcattttttagcatagtaaaagagagaaaccagagagaatgaattctaacactcaagttttggggggaaagaaaagactttattctttgcagggggtttagagctttacctgaattatctcatttaaccctcacaattctcaaatcgtttcattatcatattttacagataagaactgaagcgtggcaagattaaggaagttgctcaacttcacatagtcagaacatgactctagggagtagaggctagcgaagtggggtgcaagaggtcatccaaatttcttgaaataccagatctttttacctcatcatatatgttagattgtcagttttatcgttttcttcccagctttattatttgacaaaaaattatatatattcaaggtgtacaatgtgatgactggatataattatacattgtgtaatgattaccaaaatcaaattaagtaaaacatccttcactaatttatgtagtagttcggtgggggggcacttaagcaaatttgtcttagcaaacttcaagtaaacaatacagaattattagctatagtcaacatgttgtacattagattcccagaacttgtcttaaaactgaaaacttgtaccatttgagagagaagttttagtgttactgaaatcacagacttctgacagaatttgcaggatgctatacacaactacacaaaagtgcaaacaatagtttcttggaccaagagtcaaaaaggtcacttttttaatatattagtcaagcagacagggctatactttataaataaatacacattatctggggataagtgtttaaaaaattctttactcatataatacaaaacaggcttggggatcagtcttgaagcatgaatttttacccagtgggccatgttgagggggttgcagcacaggcccagaaaggaaagcaggctggggctctgagggcttgtgagacgaggacgctgggctgagaagatagggcttcactaggcggagggccccagggtaccccatacacaagcctgccttggcttctcgtccaatttggtgcatctcacactacacagccctgccccaccctggtgtcagcaggcattcagaaagcctcacacttctgctccagtgaacactgccaggatagccctctgaacttccacccacccatcttctgcccatttgttttctttgtcttcaattccactgctacccatcctaccccagtcccttagcctgacaaggcccaagtgtctccaccctgtgctg

SEQ ID NO: 9443 - DNA, 1360 bp, Homo sapiens
caagcgctgttctatgaggccacaacctgacccaaaggaccccgcccccatcggccgcctaaactccagagcacgagcaagaaagtggagggccacgggctgcagcgtagccgagtttgaatactggttccatagctggctagctgtacgacctcgggcaagttatcacaaaacagggagaatcccggcacctaactcggaacggtcacaggctgagatgatattactgtgtgaagtgcgcagagcggtgttgggcacatggtcatcggaactatataagaactgaagcgtggcaagattaaggaagttgctcaacttcacatagtcagaacatgactctagggagtagaggctagcgaagtggggtgcaagaggtcatccaaatttcttgaaataccagatctttttacctcatcatatatgttagattgtcagttttatcgttttcttcccagctttattatttgacaaaaaattatatatattcaaggtgtacaatgtgatgactggatataattatacattgtgtaatgattaccaaaatcaaattaagtaaaacatccttcactaatttatgtagtagttcggtgggggggcacttaagcaaatttgtcttagcaaacttcaagtaaacaatacagaattattagctatagtcaacatgttgtacattagattcccagaacttgtcttaaaactgaaaacttgtaccatttgagagagaagttttagtgttactgaaatcacagacttctgacagaatttgcaggatgctatacacaactacacaaaagtgcaaacaatagtttcttggaccaagagtcaaaaaggtcacttttttaatatattagtcaagcagacagggctatactttataaataaatacacattatctggggataagtgtttaaaaaattctttactcatataatacaaaacaggcttggggatcagtcttgaagcatgaatttttacccagtgggccatgttgagggggttgcagcacaggcccagaaaggaaagcaggctggggctctgagggcttgtgagacgaggacgctgggctgagaagatagggcttcactaggcggagggccccagggtaccccatacacaagcctgccttggcttctcgtccaatttggtgcatctcacactacacagccctgccccaccctggtgtcagcaggcattcagaaagcctcacacttctgctccagtgaacactgccaggatagccctctgaacttccacccacccatcttctgcccatttgttttctttgtcttcaattccactgctacccatcctaccccagtcccttagcctgacaaggcccaagtgtctccaccctgtgctg

SEQ ID NO: 9444 - DNA, 576 bp, Homo sapiens
tgtagagacaggagtctccctatgttgcccaggctgttcttgaactcctgggctcaagcaatcctcctgtattgctggtaacaatgtaaaatagtatagctgctttggaaaaccgtctggcagttccagagtcaccatttgacccagcaattcccctcctacaaatataccaagagaaatgcaaacataggtccacacaaaaatgtttacacaaaggctcacaacagcattattcacaatagccaaaaagtagaaacagtccaaatgtccatcaacttttaatttaaataaaacgtggtacatcccacagtggaatattatttagcaataaaaaaggaatgaaatactgatatatgctcaacatgaagacccttaaaaacatgatggacagaaaaatgccgccacaaaagaccaccacttgtgtgataccatttatgtgaaaagtctagaataggcaagtgggtagagataaagtagattactggttgcctgagggcgggggaaacgagaatggggaatgagtgctaggggtacaggatttctctaagaagggacaaaaatgttctaaaattagtt

SEQ ID NO: 9445 - DNA, 465 bp, Homo sapiens
agaatatgcatatacaaactcacacatactttattagtttttcattatgatttctgtatatcatgcaatggatgtatcttgtcagagagactgtctttcttgtaattaagcttacagttattaaatgagaacgtttgggacaataatgcagtctgacagtattgaaagtagggcccaggcacagcggctcacgcctgaaatcccggcactttgagagaccaaggaggacggatcacttgaggcccaggagtttgagatcagcctggctaacatggtgaaaccctgtctctactaaaaaatacaaaaattagctgggcatggtggtgcacacctataatcccagctactcaggaggctgaggcataagaattgcttgaacccaggaggcaggggttgcagtcagccgagatcgcgccactgcactccagcctgggtgacagagtgatgactccatctcaaaaaaaa

SEQ ID NO: 9446 - DNA, 444 bp, Homo sapiens
atgttctcagcaggcatcttcaaggccccaaattctctttttgtcccccactgtgaaaaactgattggcatctggtgatgggcagggcacgggtgcctggcgcttgcaggaagccccacaggaggtgcacagagccatggtggatgaagtgtggccaagccagcacaaggtgggggaccagatgtcgcccgattatgttccattgaaatccaaacaaagccccagattcaggatcatttccttgagactccccagttggaaattggcactgagccagaatctcacaacagctggtctccccatgctaggatttatgtgccttaccaaaaactttacctgcgtgttattgattggtttctgtaaagcaatgaaacaatattttgaagacccaaagcatactgctctctgctgaaaataaaaagaccatatatcactgaacacacc

SEQ ID NO: 9447 - DNA, 1430 bp, Homo sapiens
  misc_feature (1336)..(1336): n is a, c, g, or t
  misc_feature (1397)..(1397): n is a, c, g, or t
gagggaacagtgccctggattccggcgggggtatggaccttaggaacggggaaggatggaagaatgggcagaagcagcagtaaccgtgcccaacgccatctccacggggcgtgcctccattccgctccccgtcagccctacccactcagccctgccgcctgccgcctgccagttggctgaccccactcccaagggaagagcggcctatcgctcccagctccttgccccgaaccacccagtgtacgcgaacctcgcgggccggcgtggccttggccgggcagggggcggggcgagcgccggtgacgcggccgttgccatgggaactcgccgcccgctcgctctctggagctggagccggagctgccgccagccgcccgcctcaggctctctctgccagccgtgcggccaggcccgcggggtggtcggggggagccgggcggcagagaaggagggagcgggtacggcctcctagccgagaccggtaagccgaagcccttgagccgctcgctgccgctgccgccgccgccgccgcgaccgcgagggacaaggacaagcgccgagcagcgcctgcccaacccccggaacgcgcacccgccccaacgcccagacacggaccgtgcgggccgcccccgccccagcgccgccccacttcagcccggcccgcgccctggacgcctccgcacctctggccggctccggctcagtcccggtagctcttctccgcccccgccgcagcctccgccgcagccgcagcctccgccacagccgccgcctccacccccggccccactccgcccgcgacccctgccggggccccgaccccggccctatccccggccccgcccgcggccccaccaacctccgttccggccccgtacccggaggcccagccgtgggcacgatgctgcccagctccatccagatttcgggggagccgctgtccggcgccgaggtgcgggacatctgccgcggccttcgcgacaacgccgtgcgcctgctctcactgcgcggctgccgcctctgcgaccgcgactttggccgcatctgccgggccctggccggggccacgtccctggcgcagctcaaccttaacctgggcgtcgtgtccagccccagccgcatcaagcagctggctgaggctctgcggaccaaccgctccatccagtccctcttcctgcatgggagccccctgacagatgcggggctggccttgctgaacccagccctggccctccaccctgccctcgtggctctggacctgggggactgcatgctgggtgatgaagccatcaacctcatctgtggcctcctgcccccagatggggccaaatctggntgaaggagtaagctgagtgcaacctggcataccctaaggctggagcgcttgcattgcgtgncacagtccaggtcggtctcatttgataaaccct

SEQ ID NO: 9448 - DNA, 2130 bp, Homo sapiens
gagggaacagtgccctggattccggcgggggtatggaccttaggaacggggaaggatggaagaatgggcagaagcagcagtaaccgtgcccaacgccatctccacggggcgtgcctccattccgctccccgtcagccctacccactcagccctgccgcctgccgcctgccagttggctgaccccactcccaagggaagagcggcctatcgctcccagctccttgccccgaaccacccagtgtacgcgaacctcgcgggccggcgtggccttggccgggcagggggcggggcgagcgccggtgacgcggccgttgccatgggaactcgccgcccgctcgctctctggagctggagccggagctgccgccagccgcccgcctcaggctctctctgccagccgtgcggccaggcccgcggggtggtcggggggagccgggcggcagagaaggagggagcgggtacggcctcctagccgagaccggtaagccgaagcccttgagccgctcgctgccgctgccgccgccgccgccgcgaccgcgagggacaaggacaagcgccgagcagcgcctgcccaacccccggaacgcgcacccgccccaacgcccagacacggaccgtgcgggccgcccccgccccagcgccgccccacttcagcccggcccgcgccctggacgcctccgcacctctggccggctccggctcagtcccggtagctcttctccgcccccgccgcagcctccgccgcagccgcagcctccgccacagccgccgcctccacccccggccccactccgcccgcgacccctgccggggccccgaccccggccctatccccggccccgcccgcggccccaccaacctccgttccggccccgtacccggaggcccagccgtgggcacgatgctgcccagctccatccagatttcgggggagccgctgtccggcgccgaggtgcgggacatctgccgcggccttcgcgacaacgccgtgcgcctgctctcactgcgcggctgccgcctctgcgaccgcgactttggccgcatctgccgggccctggccggggccacgtccctggcgcagctcaaccttaacctgggcgtcgtgtccagccccagccgcatcaagcagctggctgaggctctgcggaccaaccgctccatccagtccctcttcctgcatgggagccccctgacagatgcggggctggccttgctgaacccagccctggccctccaccctgccctcgtggctctggacctgggggactgcatgctgggtgatgaagccatcaacctcatctgtggcctcctgcccccagatggggccaaatctggcttgaaggagctaacgctgagtgccaaccctggcatcacccctaagggctggagccgccttgccattgccgtggcccacagctcccaggtccgcgtcctcaatctggattacaaccccctgggtgaccatgtggcaggaatgctggctgtagctgtggcctctagtcgtaccctagaggtcctagacttggagggcacagggctcaccaaccagtcagctcagaccctgctggacatggtagaaaattaccccacagctttgcggagcctggtgttggctgagaacagcattagcccagagctgcagcaacagatctgtgacctcctctctgagggagaggaggaggaggaagtggcaggaggggctggcgacacccaggaatgggagagagggcgggagcctgctgcccaccagagaggcagcagctcctggatgtgccccagcgatcccagctctcagatggtgctaatgacgtcaggactaggggacagtctgttggctgagaccgagatgtgactctccactgggcctctgcacaccatttcacttatctatgtcccgagcaccttgccccagatatcagggtcaggccctgggacttgggagggaactggggtcaggggctgcatgggggctctggcagctcctggcagtgtggtgggaaggaagctctggaagctgtgactgagcaacagccttggggggcacttgaacccacggcaatgcctttgaacttggcagctctggctgcaacccgctggctcggaaaagattttatgaactccaaaaaaaat

SEQ ID NO: 9449 - DNA, 977 bp, Homo sapiens
gagggaacagtgccctggattccggcgggggtatggaccttaggaacggggaaggatggaagaatgggcagaagcagcagtaaccgtgcccaacgccatctccacggggcgtgcctccattccgctccccgtcagccctacccactcagccctgccgcctgccgcctgccagttggctgaccccactcccaagggaagagcggcctatcgctcccagctccttgccccgaaccacccagtgtacgcgaacctcgcgggccggcgtggccttggccgggcagggggcggggcgagcgccggtgacgcggccgttgccatgggaactcgccgcccgctcgctctctggagctggagccggagctgccgccagccgcccgcctcaggctctctctgccagccgtgcggccaggcccgcggggtggtcggggggagccgggcggcagagaaggagggagcgggtacggcctcctagccgagaccggtaagccgaagcccttgagccgctcgctgccgctgccgccgccgccgccgcgaccgcgagggacaaggacaagcgccgagcagcgcctgcccaacccccggaacgcgcacccgccccaacgcccagacacggaccgtgcgggccgcccccgctgtcctgacgcggcgcaggacgcctagtttccttgccctcggggcgcggcgtcgccgtaggacgcctccgtcgtcgtctggtctgtctcctgcatcgagcgtgtgcagctggtgtctcctgtactggtgatggatcgggggccgccgcgacctgctgcaaggcgggcggcgcaacgggcgcatccccggagttcaggcgcgcgacctctttgcgcagatcgccggcgccgtgcgctacctgcacgatcatcacctggtgcaccgcgactcaagtgcgaaaacgtgctgctgagcccggacgagcgccggtcaagctcaccgcttcggttcggccgcaggccatg

SEQ ID NO: 9450 - DNA, 426 bp, Homo sapiens
cgtatgtctcttcctttacaggtttggacaaaacaaaggaacgaatgtggaacagaagtttcaaagacctctacggaaagataaagttctcggagattggttggcctacagtatctaagcggtctgtaacatatttgtaaccctaatgacctgctgctgaaggataatcaaaccacagtgactaggaaatcatttcatcattccataaagatctgctgagcccctctaagtgctgaggactatggaaagaggccacagtcagggcagatagtctttgcccttaattgctcaagaatgaagtggatgcaatcctggaactcacagttgggcaggggcagttttcagatatgacaggcctgctttcctgagatatgactcagcccagaataaatatttgtgcttcatcgaagggttttaccattagaa

SEQ ID NO: 9451 - DNA, 388 bp, Homo sapiens
cgcacttggaagggacgaccaatagttctgtgttcctgacctgtcttacagtctttcgcttctatccgcagtggaccatttggctgatcacgtcactctacagctgttctgccacatttgagcacccacattaaagacaaaagttggggagataatgaagaggcaagacagcaatatgggattggctggaaagatgacagactgcatatgcacatcaaataaattccaaacgcagccatctattcccaaggtttggacaaaacaaaggaacgaatgtggaacagaagtttcaaagacctctacggaaagataaagttctcggaggtatcaacctcatatgaaagggtcttttaaaaggtcattttattaaagctatggagaagaaata

SEQ ID NO: 9452 - DNA, 519 bp, Homo sapiens
tctcccagagctccagagcagcacaaaaaggcatccaaatatttcctgtgcttccctgtcctctcacctcaagagggatgcaaaagacaaggctggagtgacctcaagcagtctagcagtcttgcaagttgtatgaactggaaacacaagtccagaggagaacaaggccatcttgaggataccagcaaggatagatcactatgcccggaagccaataggagccatcataaataaacaagaatttctgaggacaaaggtccccctcttgatagacatcaaagtatgatgacttaaggccccagaacttagaggcaactcagggagaaaatggtgggggaaaaaaaactccggaacagacttaataaataattgaccaaaggtagcctgagttgaatatgattgaaattaagttcagttacagaataatgttatatttgttttttgcacagaggattttgcagcctgagacttttacctgcttggctataaagaaataaaacttgtttacctttgcaaaca

SEQ ID NO: 9453 - DNA, 618 bp, Homo sapiens
tggttttctcttcttgatggagcctgtcctttagtagcctcctgagcttgaatatctaaaatgtctttatttctactgtaatattatcaaatatatatctggtctttgtctctgccttctgatatacaactcctaaaatccttgagatctctaaagtgatgtctttttgtatgctagtaagatgactgatggcggacagctcctatgtagcttcaggatagggactggacatctgaaagaccagggcatgattagaggggttgaaactttcagcccaccccccaaactcccagaggttgggggagagggactgaaagtgacgttgatcgccagtggccaatgatttaatcaatcatgcctatgtaatgagggctcctaaaaacccaaaaggacagggttcagagagcttgtggatagccaaatgtgtgggggcttccaggaaggtggacaagaacacgtccacatgctgagagaatggcacttcgcaactccttgcagacagaagctcctgctcttgggactcttctaggcttcatcctgtgtatcttttcatctggctatttgtagcctttaaaatagccttgtaataaacatgtgtttccctgagttctgtgaact

SEQ ID NO: 9454 - DNA, 337 bp, Homo sapiens
agttcatgttgtccagttttgaggtcttgaaagaagttgcaccagtatgagaatagtggatcagttttctctaggatccagaaagcatatcaggcagccttggggtgaggaaaggagcccggcctctccagcagccacacaggcctgcagtaggatggggttggggctggccatgtggatcacttgggcctcatgaggggaaaggaaataccagggggcagaggaggagcatgggggcagctggttgcctaaggagaaggcacctcagggaaggggactgtattcgtttgttttcacactgctataaagaaatacctgagattgggtaatttataaa

SEQ ID NO: 9455 - DNA, 2205 bp, Homo sapiens
agcggagacatatgacagaagactgaacaaccagaagttatgaagataggtactgtgggtgttagaaagattcacggcaaaacagggaagcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgctgaactgtgtggatacca

SEQ ID NO: 9456 - DNA, 1632 bp, Homo sapiens
agcggagacatatgacagaagactgaacaaccagaagttatgaagataggtactgtgggtgttagaaagattcacggcaaaacagggaagcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatgg

SEQ ID NO: 9457 - DNA, 2141 bp, Homo sapiens
tagatgtttttgatattttaaaaaagcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgctgaactgtgtggatacca

SEQ ID NO: 9458 - DNA, 2209 bp, Homo sapiens
gggcgattatggggactacagtgagccaagcctcccaccggatcatactgtggagacagaaaagtgaatcaggagctgtatctgctctctaaggcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgctgaactgtgtggatacca

SEQ ID NO: 9459 - DNA, 2538 bp, Homo sapiens
aggaataggtataatatggccactcatgcctatctacctgacttcttaacttcaagaagtgcttttgcagcttttgaccccttacagtatacctcatttgatatatactgtagcaacttagaattctttacacaaaataatgtatttgataatcaagccatatacagcatccacctgcaggctgcacagacgaggagctgtgccaggtctagaaactcgatttgtatgagtttactcaggggtagggaagtaacacacaaagactaaatgcaaagagactagtgtataaaccagaatgccactctattaatttgtaatgagaattatttattttccataacaaaactttaagaatatgctataacacacgcacgcacgcatacgcgcatgcactaccctcaccaagaaggctcctggtaagcatggtatcaatgccacgaagtcctggagaaacattccctctcctaagaattgagaacatctagagctgctccttcattttacaaacaaggagattgaggcccagagagattaagtgactagttcatgatacttgtgcaatgaggcagtgggggacctggcactgttattacaagcatttatttgaattctgtagtaccactgctgacactaattctgttctttctgcagagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgctgaactgtgtggatacca

SEQ ID NO: 9460 - DNA, 1827 bp, Homo sapiens
agcggagacatatgacagaagactgaacaaccagaagttatgaagataggtactgtgggtgttagaaagattcacggcaaaacagggaagcatctaggctgcttgtggaagtcagaccaaaatagcaggaaggtattgcagcaagatggatttgggaaaggaccaatctcatttgaagcaccatcagacacctgaccctcatcaagaagagaaccattctccagaagtcattggaacctggagtttgagaaacagagaactacttagaaaaagaaaagctgaagtgcatgaaaaggaaacatcacaatggctatttggagaacagaaaaaacgcaagcagcagagaacaggaaaaggaaatcgaagaggcagaaagagacaacaaaacacagaattgaaggtggagcctcagccacagatagaaaaggaaatagtggagaaagcactggcacctatagagaaaaaaactgagccacctgggagcataaccaaagtatttccttcagtagcctccccgcaaaaagttgtgcctgaggaacacttttctgaaatatgtcaagaaagtaacatatatcaggagaatttttctgagtaccaagaaatagcagtacaaaaccattcttctgaaacatgccaacatgtgtctgaacctgaagacctctctcctaaaatgtaccaagaaatatctgtacttcaagacaattcttccaaaatatgccaagacatgaaggaacctgaagacaactctcctaacacatgccaagtaatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtgcctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagtttatgcgtgattttctcaaaatattgtaaaacttttgacaatgctcattaatattattttttctatttgtagaccatatctgaaagaaataacattttttaaggctctaccacatagacaatatcatgctagaatgtgtgtgtgtgtgtgtgtgtgtgtgtgtatgtatgtataggtcggggagaggatagtggtgggaacagacaaataaggaagcggggaggactggataattggttttcccccctaagaacatttatttacgtcttaagagcagataagtgactaagactgaacacatacattttgtggagtatatagttttcttgtaaatgctgttcaattattaatgtaacagtagcatcaaaattttattcaggctttagttgactcttttggtcagttttaacaattctccttaaaagatattttggagtgatgaatgtagtttacttttgtatttgaattttgattttctatttttattttttaaatattgtatttgtgcacaatgtacattaaatcattattacatgctgaactgtgtggatacca

SEQ ID NO: 9461 - DNA, 483 bp, Homo sapiens
aaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaaggtaagggctgtttatagcaccaaggtaggtacatctcccccagagtagtgatttacaactttctctgacaatcctgggtattccctgttatttcaatggatactgtgaatttcattgactagttttaagtgaacaatattttcatgcaaccaacgtctgtcttggcatatttcaaagagttaaaaaaattgaaaatgcaagcatgtacattaagt

SEQ ID NO: 9462 - DNA, 1929 bp, Homo sapiens
tattgttggtaggcacatcgtgtcaagtgaagtagttttataggtatgggttttttctcccccttcaccagggtgggtggaataagttgatttggccaatgtgtaatatttaaactgttctgtaaaataagtgtctggccattggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatatggacatcttcaatcttaaacatttctatttagctgattggttctcacatatacttctaaaagaacttttatgttataagagttacttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaatcacatttgggaagggtacttatcttaatgactaatgacttaattgggaaagttgaattcttgtaaaatacaaaatccaaggacttcttggatttaatctaattgtcacttcttagcagatcacttttttgataatgaaagttaagcatactgaatgctacttttgattgacaaactggctataatagtctaggggaaaaatccctaaacagataaagattcctaaagtaatggtggcagctgatgtttcagtgaacttttatcttgatgcgtttaaatggaagtaatgccagacctgagatttttaaggcatttttacagcttgtattgaaatgattggagacatggtttctttattagctattttgagacctgtggagttaagcaaagaccccaaaagagcaaagaccccaaaagagcaaagaccccaaaag

SEQ ID NO: 9463 - DNA, 4596 bp, Homo sapiens
tattgttggtaggcacatcgtgtcaagtgaagtagttttataggtatgggttttttctcccccttcaccagggtgggtggaataagttgatttggccaatgtgtaatatttaaactgttctgtaaaataagtgtctggccattggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatatggacatcttcaatcttaaacatttctatttagctgattggttctcacatatacttctaaaagaacttttatgttataagagttacttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaatcacatttgggaagggtacttatcttaatgactaatgacttaattgggaaagttgaattcttgtaaaatacaaaatccaaggacttcttggatttaatctaattgtcacttcttagcagatcacttttttgataatgaaagttaagcatactgaatgctacttttgattgacaaactggctataatagtctaggggaaaaatccctaaacagataaagattcctaaagtaatggtggcagctgatgtttcagtgaacttttatcttgatgcgtttaaatggaagtaatgccagacctgagatttttaaggcatttttacagcttgtattgaaatgattggagacatggtttctttattagctattttgagacctgtggagttaagcaagacttttaaaaattggcaccatatacatctagttagttcctttactcttatttttttaaataaaagtagtacacatcatttccagggttgtaaatatatttggggcttgtttttggtatggatttaaaaggaggatattaagtattcattctaattttgttatttttctagttgccagagatggttgcactgaaatagaacagggagttgcatacaaagcctaaatgtgtattggatttcgaaaatactaggttggtgcaattggttttgtaccaacctaacatgtctttaggaaagtaccatcatgtggaaggaaacaacaggtgttaaaaggttcaaaggaatgagaaataggaagttactagaacctaactgatgttgaccttagaggtaagattattcaggtatattagtggacctccagtccaatggtatagcaaattccagggatctcaggtgcatgcaattttactttctaaagtaaacacttagaaaatagattataacccagacgttttggattatactgagacaaatatgtaaataagttttagcaagtctgaacatgtaccagcgagatcttcaggttaactaagaaaagcccagaaacttcattatttactgtgctttgtatggcataactggtaacaaggcagtaaaatgttacatatttgaactggaccatagtaattaaatgatttatcaatatcatttgcaagataattgtcaggttgagttaatagtaagtggcagcttcccagaaatttgggttatttggcctaggctgtgccctgggattacctcttcatcttccttgacttttaagttcaaatttggaggttatgtgaagtgattgaaataaatctttcaggctgaggaagtcggtaatttcaagaatatagtgaaaacaaggttgtaatctaaacatgagaagcttaagtttaggaaatggttagaatataaattgctaaagccatcatgattttggccacagatgaaaatatgaacactggaaatgagcgccatttaaatgagatgctgtatgtaagccaggggtcagcaaagttcagcctgtgacctggtgtgtgtgtgtgtgtgtgtgtgtgtgtgtgtgtgtgtgtgtgtgtccgtgtccctgagttaagaatggtttttaggcttgtataggattaaaaaaaaaaaaaaacccacagaaaaatgtaggcagcccagcataagataccgcctttcacagaaatgtttgctgaccccggaactgtcactctcgggttacaagagtttgtttctttgaaacagtctggctctgtcacccaggctggagtgcagtggcatgatctcaggtcactgcagcctccacctcccgggttcaagcaattctgcctcagcctcctgagtagctgggattacaggtgtgcaccaccacagacagctaattttacaggtgtacaccaccacacccaagaatcacttgaacccgggaggtgggggttgcagtgagccaagatcatggcactgtactccagtctgggtgacacactgtctgaaaaataaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatcttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagattttaggaccaaaaagatctctaatttaaagaaacagtttttatatacctagaatgaagattctgtttaaagcggttttggttaacttggttcttgacatttgcctaaaattttgttggattgggactaaaatgttctattagccaatgaataacgtccaagtaaatttttgttttattttgggaactttgtata

SEQ ID NO: 9464 - DNA, 4127 bp, Homo sapiens
tattgttggtaggcacatcgtgtcaagtgaagtagttttataggtatgggttttttctcccccttcaccagggtgggtggaataagttgatttggccaatgtgtaatatttaaactgttctgtaaaataagtgtctggccattggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatatggacatcttcaatcttaaacatttctatttagctgattggttctcacatatacttctaaaagaacttttatgttataagagttacttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaatcacatttgggaagggtacttatcttaatgactaatgacttaattgggaaagttgaattcttgtaaaatacaaaatccaaggacttcttggatttaatctaattgtcacttcttagcagatcacttttttgataatgaaagttaagcatactgaatgctacttttgattgacaaactggctataatagtctaggggaaaaatccctaaacagataaagattcctaaagtaatggtggcagctgatgtttcagtgaacttttatcttgatgcgtttaaatggaagtaatgccagacctgagatttttaaggcatttttacagcttgtattgaaatgattggagacatggtttctttattagctattttgagacctgtggagttaagcaagacttttaaaaattggcaccatatacatctagttagttcctttactcttatttttttaaataaaagtagtacacatcatttccagggttgtaaatatatttggggcttgtttttggtatggatttaaaaggaggatattaagtattcattctaattttgttatttttctagttgccagagatggttgcactgaaatagaacagggagttgcatacaaagcctaaatgtgtattggatttcgaaaatactaggttggtgcaattggttttgtaccaacctaacatgtctttaggaaagtaccatcatgtggaaggaaacaacaggtgttaaaaggttcaaaggaatgagaaataggaagttactagaacctaactgatgttgaccttagaggtaagattattcaggtatattagtggacctccagtccaatggtatagcaaattccagggatctcaggtgcatgcaattttactttctaaagtaaacacttagaaaatagattataacccagacgttttggattatactgagacaaatatgtaaataagttttagcaagtctgaacatgtaccagcgagatcttcaggttaactaagaaaagcccagaaacttcattatttactgtgctttgtatggcataactggtaacaaggcagtaaaatgttacatatttgaactggaccatagtaattaaatgatttatcaatatcatttgcaagataattgtcaggttgagttaatagtaagtggcagcttcccagaaatttgggttatttggcctaggctgtgccctgggattacctcttcatcttccttgacttttaagttcaaatttggaggttatgtgaagtgattgaaataaatctttcaggctgaggaagtcggtaatttcaagaatatagtgaaaacaaggttgtaatctaaacatgagaagcttaagtttaggaaatggttagaatataaattgctaaagccatcatgattttggccacagatgaaaatatgaacactggaaatgagcgccatttaaatgagatgctgtatgtaagccaggggtcagcaaagttcagcctgtgacctggtgtgtgtgtgtgtgtgtgtgtgtgtgtgtgtgtgtgtgtgtgtgtccgtgtccctgagttaagaatggtttttaggcttgtataggattaaaaaaaaaaaaaaacccacagaaaaatgtaggcagcccagcataagataccgcctttcacagaaatgtttgctgaccccggaactgtcactctcgggttacaagagtttgtttctttgaaacagtctggctctgtcacccaggctggagtgcagtggcatgatctcaggtcactgcagcctccacctcccgggttcaagcaattctgcctcagcctcctgagtagctgggattacaggtgtgcaccaccacagacagctaattttacaggtgtacaccaccacacccaagaatcacttgaacccgggaggtgggggttgcagtgagccaagatcatggcactgtactccagtctgggtgacacactgtctgaaaaataaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatcttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggta

SEQ ID NO: 9465 - DNA, 4002 bp, Homo sapiens
  misc_feature (3871)..(3872): n is a, c, g, or t
  misc_feature (3874)..(3874): n is a, c, g, or t
  misc_feature (3881)..(3881): n is a, c, g, or t
  misc_feature (3888)..(3889): n is a, c, g, or t
  misc_feature (3898)..(3898): n is a, c, g, or t
  misc_feature (3914)..(3914): n is a, c, g, or t
  misc_feature (3919)..(3919): n is a, c, g, or t
tattgttggtaggcacatcgtgtcaagtgaagtagttttataggtatgggttttttctcccccttcaccagggtgggtggaataagttgatttggccaatgtgtaatatttaaactgttctgtaaaataagtgtctggccattggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatatggacatcttcaatcttaaacatttctatttagctgattggttctcacatatacttctaaaagaacttttatgttataagagttacttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaatcacatttgggaagggtacttatcttaatgactaatgacttaattgggaaagttgaattcttgtaaaatacaaaatccaaggacttcttggatttaatctaattgtcacttcttagcagatcacttttttgataatgaaagttaagcatactgaatgctacttttgattgacaaactggctataatagtctaggggaaaaatccctaaacagataaagattcctaaagtaatggtggcagctgatgtttcagtgaacttttatcttgatgcgtttaaatggaagtaatgccagacctgagatttttaaggcatttttacagcttgtattgaaatgattggagacatggtttctttattagctattttgagacctgtggagttaagcaagacttttaaaaattggcaccatatacatctagttagttcctttactcttatttttttaaataaaagtagtacacatcatttccagggttgtaaatatatttggggcttgtttttggtatggatttaaaaggaggatattaagtattcattctaattttgttatttttctagttgccagagatggttgcactgaaatagaacagggagttgcatacaaagcctaaatgtgtattggatttcgaaaatactaggttggtgcaattggttttgtaccaacctaacatgtctttaggaaagtaccatcatgtggaaggaaacaacaggtgttaaaaggttcaaaggaatgagaaataggaagttactagaacctaactgatgttgaccttagaggtaagattattcaggtatattagtggacctccagtccaatggtatagcaaattccagggatctcaggtgcatgcaattttactttctaaagtaaacacttagaaaatagattataacccagacgttttggattatactgagacaaatatgtaaataagttttagcaagtctgaacatgtaccagcgagatcttcaggttaactaagaaaagcccagaaacttcattatttactgtgctttgtatggcataactggtaacaaggcagtaaaatgttacatatttgaactggaccatagtaattaaatgatttatcaatatcatttgcaagataattgtcaggttgagttaatagtaagtggcagcttcccagaaatttgggttatttggcctaggctgtgccctgggattacctcttcatcttccttgacttttaagttcaaatttggaggttatgtgaagtgattgaaataaatctttcaggctgaggaagtcggtaatttcaagaatatagtgaaaacaaggttgtaatctaaacatgagaagcttaagtttaggaaatggttagaatataaattgctaaagccatcatgattttggccacagatgaaaatatgaacactggaaatgagcgccatttaaatgagatgctgtatgtaagccaggggtcagcaaagttcagcctgtgacctggtgtgtgtgtgtgtgtgtgtgtgtgtgtgtgtgtgtgtgtgtgtgtccgtgtccctgagttaagaatggtttttaggcttgtataggattaaaaaaaaaaaaaaacccacagaaaaatgtaggcagcccagcataagataccgcctttcacagaaatgtttgctgaccccggaactgtcactctcgggttacaagagtttgtttctttgaaacagtctggctctgtcacccaggctggagtgcagtggcatgatctcaggtcactgcagcctccacctcccgggttcaagcaattctgcctcagcctcctgagtagctgggattacaggtgtgcaccaccacagacagctaattttacaggtgtacaccaccacacccaagaatcacttgaacccgggaggtgggggttgcagtgagccaagatcatggcactgtactccagtctgggtgacacactgtctgaaaaataaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatcttttttttttttttttgagcttagaattcccatttggacagaatttagccttgggggcgnngnataactncgtgacnnaacggggtncccatgtggtccactnctaanggggaggggacaaacgttacccgaccaacgttcgaaacacggaatacacagaactaatttctccggacctaagaatggtataa

SEQ ID NO: 9466 - DNA, 1829 bp, Homo sapiens
gctgccgcctactactactaaattcgcggccgctcgacaaacatgagaagcttaagtttaggaaatggttagaatataaattgctaaagccatcatgattttggccacagatgaaaatatgaacactggaaatgagcgccatttaaatgagatgctgtatgtaagccaggggtcagcaaagttcagcctgtgacctggtgtgtgtgtgtgtgtgtgtgtgtgtgtgtgtgtgtgtgtgtgtgtccgtgtccctgagttaagaatggtttttaggcttgtataggattaaaaaaaaaaaaaaacccacagaaaaatgtaggcagcccagcataagataccgcctttcacagaaatgtttgctgaccccggaactgtcactctcgggttacaagagtttgtttctttgaaacagtctggctctgtcacccaggctggagtgcagtggcatgatctcaggtcactgcagcctccacctcccgggttcaagcaattctgcctcagcctcctgagtagctgggattacaggtgtgcaccaccacagacagctaattttacaggtgtacaccaccacacccaagaatcacttgaacccgggaggtgggggttgcagtgagccaagatcatggcactgtactccagtctgggtgacacactgtctgaaaaataaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatcttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagattttaggaccaaaaagatctctaatttaaagaaacagtttttatatacctagaatgaagattctgtttaaagcggttttggttaacttggttcttgacatttgcctaaaattttgttggattgggactaaaatgttctattagccaatgaataacgtccaagtaaatttttgttttattttgggaactttgtata

SEQ ID NO: 9467 - DNA, 1351 bp, Homo sapiens
gcttgctaaaccattctgctgcgacgcgcggacaccatattatggtaacgatggatgtatgagtcatcagcatgcctataccatatcgaatatcctggcctcatagattagtgttgggatgctccccaatcatggaacgtgcggtccagaccgaggtgttctgctgtctggccagatggagttctagattgctcattgtctcggatctatcgagtctgagacgctccaagcaagctctggatatctagtagtactcctgacttactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatcttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagattttaggaccaaaaagatctctaatttaaagaaacagtttttatatacctagaatgaagattctgtttaaagcggttttggttaacttggttcttgacatttgcctaaaattttgttggattgggactaaaatgttctattagccaatgaataacgtccaagtaaatttttgttttattttgggaactttgtata

SEQ ID NO: 9468 - DNA, 1372 bp, Homo sapiens
gcttgctaataccattgttctgcgcgcgcggaacacagtaatgtaacgatggatgtattggtcatcaacatgctaacgcaatcgaagtattactggctaagtagagttatgtgtttgggagtgactgcacccagataatggaacgtcgtggtggaagatctgaggtgttactagatgtacttgacagatggaagttctagatgttatgatactgagatatattagagtatagactacaaggagagctgctaatattaagatatatagacttctctgcatgatatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatcttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagattttaggaccaaaaagatctctaatttaaagaaacagtttttatatacctagaatgaagattctgtttaaagcggttttggttaacttggttcttgacatttgcctaaaattttgttggattgggactaaaatgttctattagccaatgaataacgtccaagtaaatttttgttttattttgggaactttgtata

SEQ ID NO: 9469 - DNA, 929 bp, Homo sapiens
gtttgtcgtctgtaatgtgggaacaaaaatcttgaactaggcctgctgagagattaagcacccagtagacaataggtgcgaagtaattattaattcccttctctctccctgtcaatttgctggctccagattggatacaatcttcctgctttgaccttgagtctccctccttacaaaatgcaattccatttactgagcatctgaacataattggcacctaaggaatacatgttgagtgactgaaagacctcttcaaggctcaaatgtcctcaagaatctgaagcccagcctgagccttgtgaagatctttgtaactgccttatatccccacactggtttatgcacattcattatcgtttaccatattggcttctagtttttcttaatacatcataagtttctcaagagcaaggactatgtcttacttttctttgtaaacttagctattacaagatatcctgaatatttatttgacaaattactatttgaaagatttaaattgaatcattattctaatatcagtagttaacactgattaatcttgcctgtaatactaattcctagaagtatttgaaaatataatgaaggcattaaaaaggttagtgctcacttcagcagcacatatactgaaaataatacagaaggctgggcacagtggctcaggcctgtaatcccagcactttgggaggctgaggcgggtggatcacgaggtcaggagttcaagaccgacctggccagcatcgtgaaaccccatctctactaaaaatacaaaaattagccggtgtggtggtgggtacctgtaatcccagctactcaggaggctgaggcaggagaatcgcttgtacccgggaggcggaggttgtagtgagccgagactgcgccactgcactccagcctgggcaacagtgtaagacaccatctcaaaaaaa

SEQ ID NO: 9470 - DNA, 2914 bp, Homo sapiens
agtgggctctgcggataactcagacgccattaagctggggaatccaaactctaaaagaaggacgcattttaggtaagatctagtggctagatcttcagggtgggcttcgttcttgtggaaatcagtcaagaaagatcggattcgcggttatttatgcaaatcatctgggtggattgtgtacggagttaaactgcgccttctggaccgggtctgaacaatggagactgcgctagcaaaaacgccacagaaaaggcaagttatgtttcttgctatattgttgcttttgtgggaggctggctctgaggcagttaggtattccataccagaagaaacagaaagtggctattctgtggccaacctggcaaaagacctgggtcttggggtgggggaactggccactcggggcgcgcgaatgcattacaaaggaaacaaagagctcttgcagcttgatataaagaccggcaatttgcttctatatgaaaaactagaccgggaggtgatgtgcggggcgacagaaccctgtatattgcatttccagctcttactagaaaatccagtgcagttttttcaaactgatctgcagctcacagatataaatgaccatgccccagagttcccagagaaggaaatgctcctaaaaatcccagagagcacccagccagggactgtgtttcccttaaaaatagcccaggactttgacataggtagcaacactgttcagaactacacaatcagcccaaattcacactttcatgttgctacgcataatcgcggagatggcagaaaatacccagagctggtgctggacaaagcgctggaccgggaggagcggcctgagctcagcttaacactcactgcactggacggtggggctccgcccaggtccgggaccaccacaattcgcattgtcgtcttggataataatgacaacgcccccgaatttttacaatcattctatgaggtacaggtgcccgagaacagcccccttaactccttagttgtcgttgtctccgctcgagatttagatgcaggagcatatgggagtgtagcctatgctctattccaaggcgatgaagttactcaaccatttgtaatagacgagaaaacagcagaaattcgcctgaaaagggcattggatttcgaggcaactccatattataacgtggaaattgtagccacagatggtgggggcctttcaggaaaatgcactgtggctatagaagtggtggatgtgaatgacaacgcccctgaactcaccatgtctacgctctccagccctaccccagaaaatgccccggaaactgtagttgccgttttcagtgtttctgatccagactccggggacaacggtaggatgatttgctccatccagaatgatctcccctttcttttgaagcccacattaaaaaacttttacaccctagtgacacagagaacactggacagagagagccaagccgagtacaacatcaccatcactgtcaccgacatggggacacccaggctgaaaaccgagcacaacataacggtcctggtctccgacgtcaatgacaacgcccccgccttcacccaaacctcctacaccctgttcgtccgagagaacaacagccccgccctgcacatcggcagtgtcagcgccacagacagagactcaggcaccaacgcccaggtcacctactcgctgctgccgccccagaacccacacctgcgcctcgcctccctggtctccatcaacgcggacaacggccacctgtttgccctcaggtcgctggactacgaggccctgcaggcgttcgagttccgcgtgggagccacagaccgcggctccccggcgctgagcagcgaggcgctggtgcgcgtgctggtgctggacgccaacgacaactcgcccttcgtgctgtatccgctgcagaacggctcggcgccttgcaccgagctggtgccccgggcggccgagccgggctacctggtgaccaaggtggtggcggtggacggcgactcgggccagaacgcctggctgtcgtaccagctgctcaaggccacggagcccgggctgttcagcatgtgggcgcacaatggcgaggtgcgcaccgccaggctgctgagcgagcgcgacgcggccaagcacaggctggtggtgctggtcaaggacaatggcgagcctccgcgctcggccaccgccacgctgcacgtgctcctggtggacggcttctcccagccctacctgccgctgccggaggcggccccggcccaggcccaggccgactcgctcactgtctacctggtggtggcattggcctcggtgtcgtcgctcttcctcttttcggtgctcctgttcgtggcagtgcggctgtgcaggaggagcagggcggcctcggtcggtcgctgctcggtgcccgagggcccctttccagggcatctggtggacgtgagcggcaccgggaccctatcccagagctaccactacgaggtgtgtttgaccggagactcaggggccggcgagttcaagttcctgaagccgattattcctaaccttttgccccagggcgctggtgaagaaatagggaaaactgctgccttccggaatagctttggattaaattagagatctcgtgatgacgcgttgttttctgccatttatcccaaactttttcagatctagaattcgagagtgtcatggacaaaaatttcaccttgagattgagcttttatttccctttttaatggatttgtctgttgaacttcatgctgtccaagtgttgaaaagtcaattttatttcattgcatttatttacatagtgtcattccaaatccatgcatgctgttgattttcctgagatttttttctcttcttgttggtatttgttgtgataaaccaccttaataaaatcaagtattaattttattttctata

SEQ ID NO: 9471 - DNA, 1148 bp, Homo sapiens
agtgggctctgcggataactcagacgccattaagctggggaatccaaactctaaaagaaggacgcattttaggtaagatctagtggctagatcttcagggtgggcttcgttcttgtggaaatcagtcaagaaagatcggattcgcggttatttatgcaaatcatctgggtggattgtgtacggagttaaactgcgccttctggaccgggtctgaacaatggagactgcgctagcaaaaacgccacagaaaaggcaagttatgtttcttgctatattgttgcttttgtgggaggctggctctgaggcagttaggtattccataccagaagaaacagaaagtggctattctgtggccaacctggcaaaagacctgggtcttggggtgggggaactggccactcggggcgcgcgaatgcattacaaaggaaacaaagagctcttgcagcttgatataaagaccggcaatttgcttctatatgaaaaactagaccgggaggtgatgtgcggggcgacagaaccctgtatattgcatttccagctcttactagaaaatccagtgcagttttttcaaactgatctgcagctcacagatataaatgaccatgccccagagttcccagagaaggaaatgctcctaaaaatcccagagagcacccagccagggactgtgtttcccttaaaaatagcccaggactttgacataggtagcaacactgttcagaactacacaatcagcccaaattcacactttcatgttgctacgcataatcgcggagatggcagaaaatacccagagctggtgctggacaaagcgccggaatagctttggattaaattagagatctcgtgatgacgcgttgttttctgccatttatcccaaactttttcagatctagaattcgagagtgtcatggacaaaaatttcaccttgagattgagcttttatttccctttttaatggatttgtctgttgaacttcatgctgtccaagtgttgaaaagtcaattttatttcattgcatttatttacatagtgtcattccaaatccatgcatgctgttgattttcctgagatttttttctcttcttgttggtatttgttgtgataaaccaccttaataaaatcaagtattaattttattttctata

SEQ ID NO: 9472 - DNA, 318 bp, Homo sapiens
gcagccgcctactactactaaatttcccgccggtcgaccattctcatctgctttcattgtgccttgggggaaatattttttcagaggaaaataattcttctcagcattaaaattctggttctgagagatatatacacacatatgtatatatgcacatatatgtatatttaatcacatgtgatttgagatttgatatagaagtttaaatttataggaaacctcttgtcgactagatatatttgatccaggcaggcacagatctacagtattagtcttttcctttcagcacagctttccttgagactcctccaccccatc

SEQ ID NO: 9473 - DNA, 589 bp, Homo sapiens
gtacatccatcagattttctacatagacagtcatattacctgtgaataatgatagttttacttttcctttccaccaccctggataccttttatttcttttccttttcttttcttcttcttcttatttatttattttttttctgtattacactggcttgaacctctagtacgaagtcaaatagaagtggtgagagtgggcatcttattcctttgtttttcatagataacctttagcagttaaggatcttactagtttgttcagcgtttttatctgaggtggatgttgaattttgtcaaatgctttttctgtatctatcaaggtaattatatggtttttagctttagtttgttaatatggtgaattatattgatttttttttgttgttgttttaatgttgatggggtctcgctctgttgctcaggctagagtgcagtggtgtggccgtggttttctgtaactttgaactagtgggctgaagggatcctctcgtcttagcttctcaagtagctaggacagtagatgtgtgccgccatgcctggctaatttttaatttttttttctaaaaaaaaaaaaaaaagaaataccctt

SEQ ID NO: 9474 - DNA, 255 bp, Homo sapiens
tgggtgttagaggatccttggatgaggaacgtcacatgatttttttgttgttgttttaatgttgatggggtctcgctctgttgctcaggctagagtgcagtggtgtggccgtggttttctgtaactttgaactagtgggctgaagggatcctctcgtcttagcttctcaagtagctaggacagtagatgtgtgccgccatgcctggctaatttttaatttttttttctaaaaaaaaaaaaaaaagaaataccctt

SEQ ID NO: 9475 - DNA, 451 bp, Homo sapiens
gcatgacaaaggctgaggacaaagctgcccagggaggagcccagtgtgggcacctgggacgaaaggttgaggcctcacagcagggacatggctctgccagggaggactgtcactgctgaccaccttggtgatgactccaggcacaagggcagacacagtctgacctgagaggggagcaggcacttcgaagacctcagagcaggagggccacaagtcagaccctatacgcatatcacagccctgttctctggagccactggtggcaggagcctgcacccacctcccccaggaggcccactgggatttccttagcatctccacagctcctggccaccaggaggcacagggttctgctttggatctcaggagactcccttccccgcaacctccctgtgtctcgattcctgtctctacggagcaggcactgctgtcctatgctttgcctttcctt

SEQ ID NO: 9476 - DNA, 634 bp, Homo sapiens
  misc_feature (573)..(573): n is a, c, g, or t
ccccatctctaccaaaaaaaaaaaaataagcccggtgtggtggcacacacctctggtcccagctccttgggagactgaggtgggaggatcacttgagcccaggagtttgaggctacagtgggttgtattcatgccactgcactccagcctgagtgacagagtgagaccctgttacaaaacaaagaatccctaaatggagccctctactgccctccccctgctcctggaagcctggggctccctctgatccccaattgcagctaccagcccctctacatggcattcaagaacctgcgcacccatttgatcttcattgtacatctctgtgtgcctgctctaagtccagccctatcctgggtaatgttgggaacatggtggtaacagatggacctcataggtgggaattgaacaatgagaacacatggacacaggaaggggaacatcacacttgggactgttgtggggtagggggaggggggagggatagcattaggagatatacctaagctaaatgatgagttaatgggtgcagcacaccagcatggcacatgtatacatatgtaactaacgctnacattgtgcacatgtaccctagaacttaaagtataataacaataaaataaaaataagaata

SEQ ID NO: 9477 - DNA, 501 bp, Homo sapiens
  misc_feature (295)..(295): n is a, c, g, or t
gtgcatctgatagttactctctgcccctaggaggaaagacagattcgcccttccttcccaagtcccaggctgtgtggttcccagccccaagggtagcaagtcagaacctccggagaggcttttaagcatgcacatgtccagggtcctcatcaagagactgaatcagggggtctagggctcagcacaggcaccctttttgtttttgcagtttcacaggaattctgatgtgccagtgattgtcaggtttgtccctgggcaggacccacctgcctgaccttctgtccccctgggacancagtatttccagagaggtgcttcagttgccccaccacgacttccagcgccccccatctctgtatgcagctgagctcatgatgggagcccactgtgtgctttttgttgttgttacattcctataaaaaatgttccacgcatatttgaacatctgtgttcatagtggcattattcacaatggctacaacacgaagaaagcattccaag

SEQ ID NO: 9478 - DNA, 456 bp, Homo sapiens
cctgtggttttttgcagcctacatgtttttaatggaatggaaggagcacagatgtcggggttgcatagatgtaggttagaattctgatttcctaccatgtgcccttacttaacccttaacctctgtaagccctagtttcttcatttgtaagttattgagagagttgaaagagatagtataggccaggcaccgtggctcacacctgtaatcccagcactttgggagtgtgaggcaggaggatctcttaagcacaagagttcgagaccagcctggggcaacatggtaaaaccccgtttctatggaaaaattagccaggcgtggtggcgcacgcctgtagtcgtagctactcgggaggctgaggtgggagaatcacctgagtctgggaggtcaagtctgtggtgagccatgatcatgccactgcactctagcctgagtgactgagtgagatcctggtca

SEQ ID NO: 9479 - DNA, 947 bp, Homo sapiens
ggcctgttgggggctgaggagctcgagggtcagggcgcccagtgctggaccgcgcaccctcggcctgggctccttgccggtgcttgcgcgtgcaaggctagctctttccccgccgcaaggcgaggaccacccgcccccgccgcggtcccaggtccgctggcagcctcccagcgccgggccgagagggcgctcaggctcctcaagaggtttggaaaagccggcgggtccgagggtggcgccggaacgtctgcgctctcctccggtctcccacctggagatccacggcccgggcgccccaggatggatccaagcgcagagtgcgcctcctgtgacagaggtcgacccctaagcccgggccgagggcaaagggcgcggattaaagtcctggaaactcagcaatctgcagcttccaaatggatatgagaagtgagagggaaggggatggcggggcgggttagaccaccactaagagatggggaatgggaggggtgtgtggaagagagaccaagtcttcaaagaatgccttagagtgaggacccacgggactgtctgctgaaaagggctggagaggcctttgggatcagcttcgtcgtattcccgataaggaacagcgcctaaagtgaagggacgcgtccagtcttttagctagttaatattaaaaaacatcgtctcatttattgaccgtcatcctatgagtattacctcaacatcagtgcttgcaacagtcccattttaccaaaaaggaaactgagtcacagatgttctgtgatctgcacacagcaagtggcagagctgtttgggggcccaggtctgtcggctccaccaccccagggttgacccaaaatgacgcatgaaaggctggcattataagatgctgtttcttgtttagacgaagtgatactgttacactggaagcactaataaaacccaggtataaataaaagggt

SEQ ID NO: 9480 - DNA, 303 bp, Homo sapiens
tttttttttttgggtaggaatcccttgcccaggctcctcaatgcacaagcacaggaagggctgacgtctaactcataaaaactcctactgaggggcaaattcctccatctgtgcaaaaaggagaaaggaatcatctaaactgctaggaaaggcactggtctgggaacccatcatgttggttctctcggtgactttgacattgactcttttgtgctacaactttgcagagagccaacatctccttatctacagaatatgggtgccggccttgatgaatactaggctttggaactggatcctgtg

SEQ ID NO: 9481 - DNA, 311 bp, Homo sapiens
cgaaaagtcctcaagaagtagtgttaatgtaatacaaagaactatctaatgcttaccagtaataagaaaaaaaaatacagaggtataaaaaatatataaattgtgtgctcccaccataagaaggcaaacggcatccctaagagctgtgcaaataaagccttcctggaatttgaatagagaaaaaaaacggtgtgaggatcgagtcacctgtggcacattgtaataaatttgttgaactgcattggaacagagcatacagtatgcacattgtgagcaatgatataattccaacaaaatgatatcacattaaa

SEQ ID NO: 9482 - DNA, 461 bp, Homo sapiens
atttaagtatactcagtgtttcaaagattgttgctgggaggcctaaatctgggagctagagtaacctggcacaaaatcagaattcactgtcctacatactaagctcagcagattcaactactttctcatcttccttctttgtatctacagacttaaaagctgtctggattttagttacttgattgaatttttgaagtatataaagtattcgtgttttatctcccaatttaatcccccattaggttatctgtcccgttttccttttgctcagttatatcctatgggactcacagataaacagaagtattttaccccttcttttacttttcaagaggggaaaattgtcagaaggatagtcaagtactagaaatactcattttgtcttttgtttgttcacgttgcacttcacaccatatatactttttttggtgctccttcccatggacagacttaactgaccc

SEQ ID NO: 9483 - DNA, 468 bp, Homo sapiens
tgttacatgtaatcattgcccttttttatgtgataaaataaggaaaaggtaaatcacttacttcaatcagttatttatgtggtaaatgcaatgcctctgattcattcctcagagaagtgggcttgatcttataaaaggaatgaaaaaaaaaactgcttatttggtaaatgagacaggtggcctttttgactaaagcaccaaataaggcatttttgggactcatttcctttgcagatgcattgaatattattctccatcttcctgccttacacaatacttggaacaatagaaaaatgcacctctttttcaatgaagcgtacttgtcgtctaatgattttgtctttacaagccccttttatgacatgctgtcttgtagaaatgttactttcatcctactgggcttcgtctagaaggtcaatatggttatggtttctacattctgtttcttttactgtgaaaactggcaaa

SEQ ID NO: 9484 - DNA, 582 bp, Homo sapiens
ggaagttgcagtgagccgagattgtgccactacactccagcctgggtgacagagtgagactccttctcaaaaaaaagttactgtctgcattttttattatttttaaaatttctatcttctgtccaacaattattcaatgcatggacttctataatttacttcttcattgcaattacaccatttacttatgtaaaaatatgttctttgttccattacaatttttttttttttgagacggagtctcgctctgtcacccaggctggaatgcagtggcgcaatctaggctcactgcaacctccacctcctgggttcatgccattctcctgcctcagcctcccgagtagctgggactacaggcgtgtgccaccacacccagctaattttttgtatttttagtagagacgaggtttcgctgtgttagccaggatggtctcaatctcctgacctcatgatttgcccacctcagcctcccaaagtgctgggattacaggcgtcagccaccgtgcccagactaattttatcatcttgttctctgctttttacctgctaagcttctttattgcttcttgaaatgctcatttc

SEQ ID NO: 9485 - DNA, 470 bp, Homo sapiens
gctcccctcctctcctgccatgtctcacaatggacactgcttctgaaggaagcaggcaaccctctgcctaacaaattcaggtcaatcttctacatgacaggagctcctttgttagctctcttctcccagagtcaaatctgtttttaaaattttattcagtaagtaaaagagcactgacggaggccctcatttttggaacctccttcttccttgaggactttcaccagccacattggtcttaaaattgttgagtttatctgattccagactatcctccttctaaagcagtctttttacaaagacaaaacccatcagatctgtccactgcttgaaacccttctttgatttcaggaaaagagttaaactccatggtccagcatgtaaatttcttacaagctgggctctttggactgctctagtttcatctctactattgccaaagatcctctctccacccatccccaccctcc

SEQ ID NO: 9486 - DNA, 422 bp, Homo sapiens
tggggtgtttgaatctgtgcatgttagcagttctgaattgcaggcttctcctgcattctattgggatagatgggaagtaaagagaaaacccagggaactcactgccacaccattcctcaagtcccaaggtccctagctagccagtcctcatctttccaccattcaatgtctctccatgtttatttcttgtattatatccagggatttttagttgtaagagggtgaactagagaagaatgggctactccatcttggccaaaggaaaagtcttgttcatatttttgttcataaacataatttattttacactctctatcaggggagtctatttctgttgttagtttttttctgccaggtctcatttataatggtttattatgtgttttgtaattttatattaattaataaatttattcattcat

SEQ ID NO: 9487 - DNA, 353 bp, Homo sapiens
cttctgcgagaaaaacaagggtgatccacatcccccatccctcatcttaaagtcaggttcataacggataaggcctctgatcagccaaataacaagctggaggactcaggaggcccttgctttggttcctattggaacaatacaacatagaacagggccaagaaaagggcaaaggaaatacaaaaggacgcctggaagatttgcacagggcaaaggatgacttgctgagttaatttaaagtgatgtaaattgctaagacaacactgcaaagcattcatatcattttttttttcaaggaagaaaatctaaacattttcctcaggatcttcaataataaaaatctatttatcaaa

SEQ ID NO: 9488 - DNA, 655 bp, Homo sapiens
aactacaatgccaatgaaggaatgacaaccatcattgttgtcaacaacatgtcaacaacatcaacaaatagaaagcattcctccattcatcactccttctgggaagaagtagactaagaggtaagaagcaactaatttttcatgggatttgaaactaagtaggtgaatctgaagtctgcgctgcttccattccatcccattgtctcttctgagggagaaagcttctaagggagaaagcctttggggcttggaacaaaagaagccagagtctttagagtacacactccgtacttccattaaataaatttcaacaacaggtcaaagcatgtatcttgcaaccttctttgaataaggctcagtgcaaagctggggccagtgaccttgaccttccttcatccctatctatcaaggattttttgtgagcataagaggcagcaactttacttgtatttcatttcatagcttaattatatctacatgcaattagaaaacatatggtaaggcatatttgtgaaggtcacaaaatctagtagagctggaatgccaggatttgattccaacttctgccacttactaactgcggaaccttaggcaagtcactgaacccctaagtttcctcagctgtaaaacaataataaacagagtctacaggtca

SEQ ID NO: 9489 - DNA, 695 bp, Homo sapiens
aactacaatgccaatgaaggaatgacaaccatcattgttgtcaacaacatgtcaacaacatcaacaaatagaaagcattcctccattcatcactccttctgggaagaagtagactaagaggtaagaagcaactaatttttcatgggatttgaaactaagtaggtgaatctgaagtctgcgctgcttccattccatcccattgtctcttctgagggagaaagcttctaagggagaaagcctttggggcttgctggtgatctttttctacacaaaaagttttcaaacaaaaggaacaaaagaagccagagtctttagagtacacactccgtacttccattaaataaatttcaacaacaggtcaaagcatgtatcttgcaaccttctttgaataaggctcagtgcaaagctggggccagtgaccttgaccttccttcatccctatctatcaaggattttttgtgagcataagaggcagcaactttacttgtatttcatttcatagcttaattatatctacatgcaattagaaaacatatggtaaggcatatttgtgaaggtcacaaaatctagtagagctggaatgccaggatttgattccaacttctgccacttactaactgcggaaccttaggcaagtcactgaacccctaagtttcctcagctgtaaaacaataataaacagagtctacaggtca

SEQ ID NO: 9490 - DNA, 909 bp, Homo sapiens
gaaaaataactcataggtactaagtttaatatctgggtgatgaaataatctatacaacaaaccccagtgacacgtttacctatatatcctgcacatatacccctgaacttaaataaaatgtggggaaaaaagatgtgtcttataatcaaagagatataaatgtgaattgaagaaattttgtccttttcctccagaactttatcataaagctgctcaaaatttcagaaaatctatctcagaagagcattgctgcttatgtctctagtaccatacacctatatcgagttgcatcagtagtttcatacactggtaagtctacaggtataaccatttaactaatttatcatgctgtaaagtgctggcatgtcaaagcatttatattttaaaatagatattttaaaaattactttccttttatttttcctttaaattacaagtaagtttgctcttcctgtctgtgccagggtggcgcatggtctacgtcgagcaacagagacactcaggctgtgttctcacgatgactgagtgggagacagcagcaccagcagtggcagagaccccagacatcaagctctttgggaagtggagcactgatgatgtgcacatcagtgacatttccctgcaggattacattgcagtgaaggagaaatatgccaagtacctacctcacagtgcagggtggtatgccgccaaatgcttccacaaagctcagtgtccctgtggaaggcgtataagcccagagatacggcgggacaacgggcaaacccagagggtgatttcagagattcgggggtaaacccaagcaaacacccaggcggcaaaacacaaaggccggagaaacccagggggcccgtgaaaacgggggcacaccaccgacaaacggtggagcaccgcgcggagacacacgcc

SEQ ID NO: 9491 - DNA, 754 bp, Homo sapiens
gaaaaataactcataggtactaagtttaatatctgggtgatgaaataatctatacaacaaaccccagtgacacgtttacctatatatcctgcacatatacccctgaacttaaataaaatgtggggaaaaaagatgtgtcttataatcaaagagatataaatgtgaattgaagaaattttgtccttttcctccagaactttatcataaagctgctcaaaatttcagaaaatctatctcagaagagcattgctgcttatgtctctagtaccatacacctatatcgagttgcatcagtagtttcatacactggtaagtctacaggtataaccatttaactaatttatcatgctgtaaagtgctggcatgtcaaagcatttatattttaaaatagatattttaaaaattactttccttttatttttcctttaaattacaagtaagtttgctcttcctgtctgtgccagggtggcgcatggtctacgtcgagcaacagagacactcaggctgtgttctcacgatgactgagtgggagacagcagcaccagcagtggcagagaccccagacatcaagctctttgggaagtggagcactgatgatgtgcacatcagtgacatttccctgcaggattacattgcagtgaaggagaaatatgccaagtacctacctcacagtgcagggtggtatgccgccaaatgcttccacaaagctcagtgtcccattgtggagcgccttactaactccatgatgatgcac

SEQ ID NO: 9492 - DNA, 371 bp, Homo sapiens
ccctgggctctgtctctactcccagggacctgctggaaggctggagtgcccagggagaggtatagaggtgtcataggcattagtgtagtaattggagcactaactctcgagccaactgcctgggttcgaatcctggctctagctgtatgacttttgtcaagtaacttagcctctctgtgtctcagttgcctcttctataacatggatgctaatagtacctacctcatagaattgttttggaagtaaatgaaaaatatgtaaaatgctgaagtgcctggtctacagtaagtgctcaataaatgttaactattgtgattgctgctgaatcagctacatgctgaggaaacggccaaacaagtgttaaagagaga

SEQ ID NO: 9493 - DNA, 413 bp, Homo sapiens
ttcctaagttaccattccttcccaatgctaaagaccagattctctgctctttccaataaattaatcatatcagtgagctcatctgttcatacatggtatcacttcctacctgtatatagataattcacaatctacatctctagccccatctgccactctcttctggcccacctgccagaagtcatcacccaaggttgtgtttgttgatctcacttctaccaacctgcagttggccccgctaatgactaccaccagcaccagaggtctacttctacatctcctgattggtccttcagatccctccttcttcttccagttctttctcctctcttgcatagtacttggaattacaatctatgtggtggcaggctaacttggttggaactcattatctatgaggaattctggaaaga

SEQ ID NO: 9494 - DNA, 449 bp, Homo sapiens
cttttttctccttttatgttctatctcggcctgtagcccaggtagattggttggtacctgcttacattgagactggatcttccccactcagtccaccaactcacatgccaatcttctctggaaacagcctcagagacaaacccagaagtaatactttaccagttctgtaggtattttgtaatccagttacattgatacctaaaattaactaccacagagagaaagcaattaagtaagagtaagaagacctgatttttggctaacacggtgaaaccccgtctctactaaaaatacaaaaaattattcgggcatggtggtgggcgcctgtagtcccagctacttgggaagctgaggcagaagaatggcgtgaactcgggaggtggagcttgcagtgagccgagatcacgccactgcactccagcctgggcaacagagcgagactccgtctc

SEQ ID NO: 9495 - DNA, 168 bp, Homo sapiens
ctaggattgtcgcatagtgcacttaggcaggggtatgcggcagaagagttagtggtgtttgtacagttccaggccttttttgacaagacacaattgaggtagctgaagttagagggagaccaggctccagggggtaaccttggccaccactcggctgtggaggcgttg

SEQ ID NO: 9496 - DNA, 456 bp, Homo sapiens
atgaggccaagcatggtggttcacgcctataatcgcagcactttgggaagctgtggtgggaggattgctagagcccgggaatttgagaccagcctgggcaacatggcaagaccctgtctctattttttaatagtcaaaaaaaagaagaagaagaaaacattcaaatgcttgaacatgacaaaggggttagatggcttattaagttgaattcgccatgtagcatcatgtgtgacgtaatggaaatgaatggcaaaccttgtttaacagaattaaatgaagatgattaaaagtatttctaaaacatctttatttcaaatatttatgaaaataactctgtacatttaccatacccaaggcccctaaatcttaattttgatcttaatcttgaaaatgtattgttgttagcatactttgtatagtgggttttttttgtttgtttgtttttgagacagggtc

SEQ ID NO: 9497 - DNA, 3767 bp, Homo sapiens
  misc_feature (3607)..(3607): n is a, c, g, or t
  misc_feature (3609)..(3609): n is a, c, g, or t
  misc_feature (3613)..(3613): n is a, c, g, or t
  misc_feature (3617)..(3618): n is a, c, g, or t
gaattcgtgtctcggcactcactcccggccgcccggacagggagctttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcaatgtacctaatatataccaggacaccacaatttcttggtggaaagatgggaaggaattgcttgggggacatcatcgaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatcccccggcgtgctaactgttccaggcctgacggagatggcggtcttcagttgtgaggcccacaatgacaaagggctgaccgtgtcccagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgggtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccaaagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttggttttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattaattttctgatatggcttcctaataaaatatgaactanangganaaannaaaccaatcacccacaaaacacacaaaaacgcaccaacagacaacgcaaaaacgacccacagcacgccaccgaccgtcagacacccacagccccacgccgcccggacacaccacaaggaacacggagacaccggcgacgccaacacacg

SEQ ID NO: 9498 - DNA, 2956 bp, Homo sapiens
  misc_feature (2796)..(2796): n is a, c, g, or t
  misc_feature (2798)..(2798): n is a, c, g, or t
  misc_feature (2802)..(2802): n is a, c, g, or t
  misc_feature (2806)..(2807): n is a, c, g, or t
ggtaagacagggaaacaaaacagaacccctaagcctgagatgagaacaaggattgtgagacagggaaatgcgccgtgccgttgtctaggcctacattcaggatcaagctctttacatgcatggcactttgccagcctccagcttccggatgcgtgtgcaagtgttgataaaggctggaaagtggacagatgaaaagatattattatacatctacgtgaatgagatctgcatgttgtgtgtgaagtaacatgttagtagaattagccaaaagttctataggctgtaactaaatgtcaatatggaaattgcatatttctgttcgtaagatgctagtaatttattgcatgggtcagatgatttaaatttgggtcatttttttgtccaatgacgtatgaattatcagtttctcaaaacagaaaagcatcaaaatgaaatgatgcctaggcatgctggtgtgtacctgtaattccagctactctggaggctgaggcagaagatcacttgagcccaggagttcaggggttctccaccagcctgggcaaaatagcaagagttcgtcttattaaaaaaataaatacatctatttttaaaatgttatatatatatacacacacacacacacacacatttttatatatatacacattttcaggccaggcatattaattggcatgcatatatatatatgccatatatgtgtatatatatgccatatatgtgtgtgtatatgtgtgtgtgtgtgtatatatatacacacacatatggcatatatatacacacatgccaattaatatgcctggccctgaaatgtcaggtctatcaattataagaaaaaaaacatttttaatgaaatgatggtataactcactcttcatctcagcctattgattcctaattgtcatctgtcttactgtgctccattaaatgtccctccattggaattcttaactatattagacactgggatgaaaaaaccacccagaagagagttgccctctataaaacaaagtggaaggagttgtgaggagcacttggacgcaggagttgtccaatctgaatctgaatccctggctacccacatggccatggcatgttctgtaatgtccctgagcccactgtcatcttcattacaaagtgacaatgacagggctgttgagaagactagatggagtgatacgcagcacacaactaccccctgccctcacccctgctcctgatcttcttagccctagccccagggccccaactaactcagctgtcctggtaacaactcagtttgatggcataggacagaggtcagcaaacttttcctataaagtgccaaatagcaaatatttttggctttgcaggccttttagcacctgctcaactctgccattgtgacataagaagtcatagataacgtgtaaacaaataaggatagctgtgttccaataaaactttatttacaaagtagacagtgggctggatttggctcatgggccatagtttgcccgccgccatataaagaaagagacctaaatactccttatctgcaaagttagatataactgccacatatgtgctcttcctagaaacagaatcacttttttgtcaaataccatggaacatttacaaaagttgtataaatattaggccaccaaaaaagtctcaataatttttataaaaagtagaatgaatgctgattaaaatgtgataaagattctgtaaaaacaaaggcatggattgcacaaagagatgggtgccatgctgggagacaatccacttctttttaactttcaggtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaactanangganaaannaaaccaatcacccacaaaacacacaaaaacgcaccaacagacaacgcaaaaacgacccacagcacgccaccgaccgtcagacacccacagccccacgccgcccggacacaccacaaggaacacggagacaccggcgacgccaacacacg

SEQ ID NO: 9499 - DNA, 1931 bp, Homo sapiens
  misc_feature (1771)..(1771): n is a, c, g, or t
  misc_feature (1773)..(1773): n is a, c, g, or t
  misc_feature (1777)..(1777): n is a, c, g, or t
  misc_feature (1781)..(1782): n is a, c, g, or t
ggccattactgcaggaaaaggtcccggagagctgagcagtcaagattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaactanangganaaannaaaccaatcacccacaaaacacacaaaaacgcaccaacagacaacgcaaaaacgacccacagcacgccaccgaccgtcagacacccacagccccacgccgcccggacacaccacaaggaacacggagacaccggcgacgccaacacacg

SEQ ID NO: 9500 - DNA, 3848 bp, Homo sapiens
  misc_feature (3688)..(3688): n is a, c, g, or t
  misc_feature (3690)..(3690): n is a, c, g, or t
  misc_feature (3694)..(3694): n is a, c, g, or t
  misc_feature (3698)..(3699): n is a, c, g, or t
gaattcgtgtctcggcactcactcccggccgcccggacagggagctttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcaatgtacctaatatataccaggacaccacaatttcttggtggaaagatgggaaggaattgcttgggggacatcatcgaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatcccccggcgtgctaactgttccaggcctgacggagatggcggtcttcagttgtgaggcccacaatgacaaagggctgaccgtgtcccagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgggtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccaaagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttggttttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatcacccacctggccatcttagcaagaagcccagcatcttgctcttactgcaggttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaactanangganaaannaaaccaatcacccacaaaacacacaaaaacgcaccaacagacaacgcaaaaacgacccacagcacgccaccgaccgtcagacacccacagccccacgccgcccggacacaccacaaggaacacggagacaccggcgacgccaacacacg

SEQ ID NO: 9501 - DNA, 3585 bp, Homo sapiens
gaattcgtgtctcggcactcactcccggccgcccggacagggagctttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcaatgtacctaatatataccaggacaccacaatttcttggtggaaagatgggaaggaattgcttgggggacatcatcgaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatcccccggcgtgctaactgttccaggcctgacggagatggcggtcttcagttgtgaggcccacaatgacaaagggctgaccgtgtcccagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgggtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccaaagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttggttttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggttgtcttctgatgtagagagtgtccttttctaacttgtgtaaactgatt

SEQ ID NO: 9502 - DNA, 2733 bp, Homo sapiens
gaattcgtgtctcggcactcactcccggccgcccggacagggagctttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcaatgtacctaatatataccaggacaccacaatttcttggtggaaagatgggaaggaattgcttgggggacatcatcgaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatcccccggcgtgctaactgttccaggcctgacggagatggcggtcttcagttgtgaggcccacaatgacaaagggctgaccgtgtcccagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgggtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccaaagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttggttttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatcacccacctggccatcttagcaagaagcccagcatcttgctcttactgcaggtaattccccatcttccccaaactctcagggggcttacttagtcctcagggccagtgctgcttccagacctctgggaggaaggctgctggggtcctggatcagtccaccagagggctctggttttgagctgctgctctttctgctcctgctatgctgcgtctccatgttctccagctgtttctatccactgtgcacaggtgcccttgctggtccacatcccacacagatcagagcgatgcaagactgcatcacttgaggctaggcgtggtagctcatacctgtaatcccagcactttggaatgccaaggcgggcagatcacttgagatcaggagtccgagaccagcctggccaaca

SEQ ID NO: 9503 - DNA, 314 bp, Homo sapiens
  misc_feature (154)..(154): n is a, c, g, or t
  misc_feature (156)..(156): n is a, c, g, or t
  misc_feature (160)..(160): n is a, c, g, or t
  misc_feature (164)..(165): n is a, c, g, or t
atgtatttgtcttggcttcttatcaaatacatcaagaccagaagccaagcaaacttctggtcttgatgtatttgataagaatgattcattcaatgtttaaagttgtataactgattaattttctgatatggcttcctaataaaatatgaactanangganaaannaaaccaatcacccacaaaacacacaaaaacgcaccaacagacaacgcaaaaacgacccacagcacgccaccgaccgtcagacacccacagccccacgccgcccggacacaccacaaggaacacggagacaccggcgacgccaacacacg

SEQ ID NO: 9504 - DNA, 437 bp, Homo sapiens
cagctttggccactgggagcttatctgttattctctgttcttggcggtacctggctagagtagtttcaatattgccaagtaagtctaaaataaatcaaaggaaagaaacacgtttcttctagggggaaagcttttgttgtagaagagcccattgaaaagcggaagctctgtagcatccttgtggaatcagtgcctgccccagtagccctgtttttatagtgaagtatctttgttttcattcacccaggaatgcattcacagaggaggattctgaattagtggtgaattatatagcaaagaaatccttctgtcggcgagccattgaacttacctgtaagttgactttcatttccctttttggcaaaagttaaaatagttgagaacaaagaaggatcaatagacagatttctaacaaaagccaaagatgtcgaagaaga

SEQ ID NO: 9505 - DNA, 366 bp, Homo sapiens
tcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataaggaaggatatgttgaacttacttgagacttgaaagacagtggtcggcagcggccttgtggcctttgcaaaggaattcccttaatgcctggtccttggggcaattgctctgaccattcttggcattgctttatagagatatggaaaaaccacaccagggtctgtagataaggaataaagaatattgaaggattgaaaaata

SEQ ID NO: 9506 - DNA, 329 bp, Homo sapiens
tagtggagacggggtttcaccgtgttagccaggatggtctcaatctcctgacctcatgatccgcccgcctcggcctcccaaagtgctgggatgacaggcgtgagccaccgcgcccgtcctgtttgttttgagacacggtcttgctcttgttgtccaggctggagcgcgcggtattgcagtcacagctcaccgcagcctcaaactccccaggctcaagggatccacccaccttgggctcccaaagtgctgggattacatgagctcccacgcccagtttgtgtggtttttccttgccagaaaagtccccatccatgaggccccccctcacc

SEQ ID NO: 9507 - DNA, 296 bp, Homo sapiens
aaaagttatactagaaataggatatagagatgattatatatggatattatcaatcattagttttagtattaatctgtgctttactattataaccgaggaataaccagccagtacagtcaggagctgaaggaacattgtgagaagtgaccagaagataagagtgtgagccctctgtcaggccggacatggtggctcacgcctgtaatcccagcactttgggaggccaaggcaggcggatcacgaggttaggagatcgagaccatcctggctaacacggggaaaccccatctctacta

SEQ ID NO: 9508 - DNA, 476 bp, Homo sapiens
cagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcaggtaatttggtatgccttaaacatttcctgaaggcatttggtgatgaaatataaatatatctaatgtataaagtaagagagttttgtcaaaggtaatatgcagcaaagctgactagtttgaagaggtttgggttactgaatagacgtcacacaggaa

SEQ ID NO: 9509 - DNA, 408 bp, Homo sapiens
aaaactggagttagttctcattacccttaaaaaatactttcttttgtatacacttattaaatatcccactgacattataagttctgaatataagcggttttgaatttaaatacctgtttgtgatcaagacttcatctggataatagtttatagtatttcagactggaaacgtttccaagtttggtaggaggagtagcctctactgtttagagtagttggggcagggcatgccttatacagcttttgcggtttgtgcggtatacaacagcataacatgttgggggtgatgttcattcacatcatagatttgtatattatcacagttttttttagcaggtgttggtaaagtttcttgttctaacaaaatcaatatattatgtcacatttctgacagttaagaaccttaag

SEQ ID NO: 9510 - DNA, 487 bp, Homo sapiens
gggtataatatgtgaggaatgatcagcagtaataatagttctgatagtttcgggtacctatatttttacattgttgtgctttttcattattgtgtatatttgaacatttctgtgaaacttagtttcttttcataattattttgtttattttctttagagacaggatctcgctctgttgcccaggccaatgtgtggtggtgtgatcatagctcactgcagccttgaactcctgggctcaggtgattcacctgtcttagcctctcaaatggttgggattacaggtatacaccaccatacccagctaaattttttttttttaatttttttgtagagacaagatctcgtcatgttgaccaggcttgtcttgaactcctggccccaagtgatcctcccacctcagtctcccaaagtgttgggattatatgcacgagtcactgtgcataatgattttaaaatttcagagatctcaaaagatgttactgtaccc

SEQ ID NO: 9511 - DNA, 431 bp, Homo sapiens
atcactccatccccctgggtcgtcttcatcactcttactactatctgaaatcaaatctgtttgttttttcctatagaaggtttgtaaaggccttatacagactcaccactgtgcctcacctgggcattaacacccaagaccctagccctgaaagcccagtgccaggccccagacatgctcccatcccctgccactcagcttacagtcctctttctgtttcctcttctttgtggattcacctttttttgggtgtgagcccagccatggtttaacctttttttggttcttggttatatttaatccagtatttcagatattcagaattgacaacttcagtgttcactcagtctatcacgttactagaaccagaagtgtctccaaccctgtatactatttcttacacacattgacatttgagaccactgagttca

SEQ ID NO: 9512 - DNA, 230 bp, Homo sapiens
tgtgcaatacaaaaggaacaggaagatttgaaagcggtcagacaatacttagaaatgaaagcatacaataattgatattaaaatgtcatcggttttcattcagcaaacttttgagttctatgtgccactgtgtagttcttactatagtattttataatcatgcaaaggcagacttacataatatgaaggaagatttgaggatgtcacctagaaaacagcatgtagatata

SEQ ID NO: 9513 - DNA, 348 bp, Homo sapiens
agacaacttgactccgttgggcattaaacgttggccaaagtatttctggggctgtgagtttccttgtatatccttatttagtctctccttccagctctaaaagccttctgaaaagacttaacccgtattctatctgcttttgttcctcacattttcagacaactgattaaaatcacaacttagaagagtatttcttggctcttacccttttgagtagttggagaataattgctacctttcccttcagtattctcattaatatttgagaacttcaaacggcagaaaaacacaaaaaacaaattgagaactgtgtattgcaatcttggttcatctctaacacgctggaaa

SEQ ID NO: 9514 - DNA, 290 bp, Homo sapiens
cccagccctcatcctgagccctgctgtgtgcactgtgtctgatggagaggcagcctctctggatggcagctctctccatattccaaaggcattcttctcctgttctccttccctctttttaaattaaatgggaatgccactgacgtgatgtcgtttgcactgcaggatgacagaactgttgtgtgaataccattgtatttgccaaatggtccactcgtcatttcagaacaaacaaatggatggtgtctgtaagtcggcaaacactggtgacatttagccttgtttatgtt

SEQ ID NO: 9515 - DNA, 325 bp, Homo sapiens
gaccaatagaatgtgaattgggaaagtgaaggaacaaaaaaaatcacccaataacaataattgcaatagccatttactgtactccaggtattctctcatttcgagcatccttttctttaaaccttgtaaccaccttatgatcctcattttacagatgagaaaatgggagattagagcgctttaaaaaattgccgtggtggctcgtgcctgtattcccagctacttgggaggctgaggcaggagaatcgcttgaaccagggagtcagaggttgcagtgagccaagatcgtgccactgcactctagcctgggtgacagagtgagaca

SEQ ID NO: 9516 - DNA, 703 bp, Homo sapiens
gcatgctccgggtgtcccgagagttgtcctgcgccggtgttcccacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgctcgtaaagatgaaaagctgctgtcgtttctaaaagatgtgtatgttgattccaaagatcctgtgtcttccttgcaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaagaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaa

SEQ ID NO: 9517 - DNA, 733 bp, Homo sapiens
gccaaaaccaaccacacacagacagccaaaaacagaaggaacttacggctaggaagcgaggctggggtgggtgcacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgctcgtaaagatgaaaagctgctgtcgtttctaaaagatgtgtatgttgattccaaagatcctgtgtcttccttgcaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaagaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaa

SEQ ID NO: 9518 - DNA, 555 bp, Homo sapiens
gtgttaagcgtttaggatattacaggaaattttccttgattttaatattgtgacttttttcctttccttagtctatccagaagttaaaggagagattgctcgtaaagatgaaaagctgctgtcgtttctaaaagatgtgtatgttgattccaaagatcctgtgtcttccttgcaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaagaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaa

SEQ ID NO: 9519 - DNA, 533 bp, Homo sapiens
ggactacaatttggtgacatgagatttgggtggggacacagatccaaaccatattagttgttatttgaagaggaatagtgtagatttgagaagtatgaaagtagatgtcaaatcttttctctcatcctaaaacctttttttttttgatactaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaagaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaa

SEQ ID NO: 9520 - DNA, 2411 bp, Homo sapiens
gcatgctccgggtgtcccgagagttgtcctgcgccggtgttcccacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgctcgtaaagatgaaaagctgctgtcgtttctaaaagatgtgtatgttgattccaaagatcctgtgtcttccttgcaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaagaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaatatttaatgctctcattgtgagggcatactcttaatatttattgagctccctgacttttcaagattgccatagaatatcttttgttttattttaatttggtttaggcatatttcataagtgcatgtcagcatgactgagcacatctgtacctttattatggtgaaagagttaattcgttattttaggcacatataccaacttttaaattggtcatattaccccttgggaaatgtcctgaatccctcaactgagttttactttccaagttaggtgtttagttcattcttctcatgcgatagtgaaagtaaaagctttcctgacccttaagactgacattttctcgttagggaaagagactcgatagcagggtagactaacagtagttcccaaataaaggcacacaggagaaaatgaatcaatagaatctaattaaaattactactccagggaataagaagtattgaggatttattttattttgaattggttttaagtatggaataattgtctttacagttataaaaagtaattagtggtgtttacaaaatgttgggaatttctgctttgacagataggtaagtcccatgggaatttctgctttgacaaatagttaagtcccatggccttcagagaggcaggaagcagaaactttcaaaaaagtaacatttctctggatttaatgtggaaatagagaaaaatttaaagaataattaaaaaaccatggtagatgaaatttggtgattacatatagtttcggatgttaatgctagttgagagaagagaaaaagatagcaagtagaagcagagaacaggatcattggaagggacctgagaaattgccatttcatccattttagcaaatttaattagcatagcatgtaccagtactaggatcttgagtgagtgtgtgagtttagctctgcctaatatattactacttgggggatctttgggagactatatcttcttggagattgagtttcttctataaaataagcataatgctaccctaaatgtaagggttatcatgaagataaataataaaggactacaaaggaccaagcaaataggaattattttttgcggtggagaaacaagtgcctggggagaatatatgaccgaagattctgtagtttatgacttaaacaggcccagaatttagtttttcaaatcctagtagtgtgttttttctgtcttgccaaaaagcagcacacctcaaagaagggaaaaggtgtgaattgtgggtatattagggttattagtgcttccgagggaagataggcatcactacttcccagagatgcccctggaaatgatatagaggatgttgaagaattcaatgtgatgacggaatgaggcatttgtagtaatgctgagaacagaaaaatggactaagtggaaaatttgtaagcatgactttgaatgtagatttgttatgtgaacaaactacctagtttatttttagttcaatacaataattgttttaagaaaacatgaaataactactcaatataaaatgcattttaaaactgtaaataagtcaaaactttattctttttatcataatggtcactagctgagtcacaaatactagtacactcttctgagccatcttctttattcatatctacattgtgtggttaggcatctgttatgtggtgtcacatgataaaataaagaacttcttcccataccaaaaaaaaatcc

SEQ ID NO: 9521 - DNA, 1828 bp, Homo sapiens
gcatgctccgggtgtcccgagagttgtcctgcgccggtgttcccacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgctcgtaaagatgaaaagctgctgtcgtttctaaaagatgtgtatgttgattccaaagatcctgtgtcttccttgcaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaagaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaatatttaatgctctcattgtgagggcatactcttaatatttattgagctccctgacttttcaagattgccatagaatatcttttgttttattttaatttggtttaggcatatttcataagtgcatgtcagcatgactgagcacatctgtacctttattatggtgaaagagttaattcgttattttaggcacatataccaacttttaaattggtcatattaccccttgggaaatgtcctgaatccctcaactgagttttactttccaagttaggtgtttagttcattcttctcatgcgatagtgaaagtaaaagctttcctgacccttaagactgacattttctcgttagggaaagagactcgatagcagggtagaactatatcttcttggagattgagtttcttctataaaataagcataatgctaccctaaatgtaagggttatcatgaagataaataataaaggactacaaaggaccaagcaaataggaattattttttgcggtggagaaacaagtgcctggggagaatatatgaccgaagattctgtagtttatgacttaaacaggcccagaatttagtttttcaaatcctagtagtgtgttttttctgtcttgccaaaaagcagcacacctcaaagaagggaaaaggtgtgaattgtgggtatattagggttattagtgcttccgagggaagataggcatcactacttcccagagatgcccctggaaatgatatagaggatgttgaagaattcaatgtgatgacggaatgaggcatttgtagtaatgctgagaacagaaaaatggactaagtggaaaatttgtaagcatgactttgaatgtagatttgttatgtgaacaaactacctagtttatttttagttcaatacaataattgttttaagaaaacatgaaataactactcaatataaaatgcattttaaaactgtaaataagtcaaaactttattctttttatcataatggtcactagctgagtcacaaatactagtacactcttctgagccatcttctttattcatatctacattgtgtggttaggcatctgttatgtggtgtcacatgataaaataaagaacttcttcccataccaaaaaaaaatcc

SEQ ID NO: 9522 - DNA, 2481 bp, Homo sapiens
gcatgctccgggtgtcccgagagttgtcctgcgccggtgttcccacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgctcgtaaagatgaaaagctgctgtcgtttctaaaagatgtgtatgttgattccaaagatcctgtgtcttccttgcagggcctatgatgttgtgaaggacacagccattaaacaaatgagcaacaatgtgaccataattatgggaaaagtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaagaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaatatttaatgctctcattgtgagggcatactcttaatatttattgagctccctgacttttcaagattgccatagaatatcttttgttttattttaatttggtttaggcatatttcataagtgcatgtcagcatgactgagcacatctgtacctttattatggtgaaagagttaattcgttattttaggcacatataccaacttttaaattggtcatattaccccttgggaaatgtcctgaatccctcaactgagttttactttccaagttaggtgtttagttcattcttctcatgcgatagtgaaagtaaaagctttcctgacccttaagactgacattttctcgttagggaaagagactcgatagcagggtagactaacagtagttcccaaataaaggcacacaggagaaaatgaatcaatagaatctaattaaaattactactccagggaataagaagtattgaggatttattttattttgaattggttttaagtatggaataattgtctttacagttataaaaagtaattagtggtgtttacaaaatgttgggaatttctgctttgacagataggtaagtcccatgggaatttctgctttgacaaatagttaagtcccatggccttcagagaggcaggaagcagaaactttcaaaaaagtaacatttctctggatttaatgtggaaatagagaaaaatttaaagaataattaaaaaaccatggtagatgaaatttggtgattacatatagtttcggatgttaatgctagttgagagaagagaaaaagatagcaagtagaagcagagaacaggatcattggaagggacctgagaaattgccatttcatccattttagcaaatttaattagcatagcatgtaccagtactaggatcttgagtgagtgtgtgagtttagctctgcctaatatattactacttgggggatctttgggagactatatcttcttggagattgagtttcttctataaaataagcataatgctaccctaaatgtaagggttatcatgaagataaataataaaggactacaaaggaccaagcaaataggaattattttttgcggtggagaaacaagtgcctggggagaatatatgaccgaagattctgtagtttatgacttaaacaggcccagaatttagtttttcaaatcctagtagtgtgttttttctgtcttgccaaaaagcagcacacctcaaagaagggaaaaggtgtgaattgtgggtatattagggttattagtgcttccgagggaagataggcatcactacttcccagagatgcccctggaaatgatatagaggatgttgaagaattcaatgtgatgacggaatgaggcatttgtagtaatgctgagaacagaaaaatggactaagtggaaaatttgtaagcatgactttgaatgtagatttgttatgtgaacaaactacctagtttatttttagttcaatacaataattgttttaagaaaacatgaaataactactcaatataaaatgcattttaaaactgtaaataagtcaaaactttattctttttatcataatggtcactagctgagtcacaaatactagtacactcttctgagccatcttctttattcatatctacattgtgtggttaggcatctgttatgtggtgtcacatgataaaataaagaacttcttcccataccaaaaaaaaatcc

SEQ ID NO: 9523 - DNA, 716 bp, Homo sapiens
gcatgctccgggtgtcccgagagttgtcctgcgccggtgttcccacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtcgtgagtggtgcgagggcgtttcggggcccgggggcgcggagtccctgtgctgcccggctgtccctagcgtgggtccggaggccgagggatcggcgtcagcctgctcggccgcagccgctcgggttggcggagcgttggaagggggagccgccaggccggtgacattgagactgtcctccgcgcccgcggtgaggtcggcggccccgcctacttccgagacccagaggcagcagccagtgctcccgctaaccaggccctcgccggctgctgtcacggacttgatacagggaatcaaaatccgagagggtcacagagctttctctaggggtcttcactggacgatggacgcagagcctgacctggaattttgatttccatctaaagtattttcctaacagtccaaatgattatgtttattttttaaaaaaattaaagtggttaggccagccaaaatgatatcttttctaactgtgcttttaagttctctccttgggacc

SEQ ID NO: 9524 - DNA, 2441 bp, Homo sapiens
gccaaaaccaaccacacacagacagccaaaaacagaaggaacttacggctaggaagcgaggctggggtgggtgcacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgctcgtaaagatgaaaagctgctgtcgtttctaaaagatgtgtatgttgattccaaagatcctgtgtcttccttgcaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaagaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaatatttaatgctctcattgtgagggcatactcttaatatttattgagctccctgacttttcaagattgccatagaatatcttttgttttattttaatttggtttaggcatatttcataagtgcatgtcagcatgactgagcacatctgtacctttattatggtgaaagagttaattcgttattttaggcacatataccaacttttaaattggtcatattaccccttgggaaatgtcctgaatccctcaactgagttttactttccaagttaggtgtttagttcattcttctcatgcgatagtgaaagtaaaagctttcctgacccttaagactgacattttctcgttagggaaagagactcgatagcagggtagactaacagtagttcccaaataaaggcacacaggagaaaatgaatcaatagaatctaattaaaattactactccagggaataagaagtattgaggatttattttattttgaattggttttaagtatggaataattgtctttacagttataaaaagtaattagtggtgtttacaaaatgttgggaatttctgctttgacagataggtaagtcccatgggaatttctgctttgacaaatagttaagtcccatggccttcagagaggcaggaagcagaaactttcaaaaaagtaacatttctctggatttaatgtggaaatagagaaaaatttaaagaataattaaaaaaccatggtagatgaaatttggtgattacatatagtttcggatgttaatgctagttgagagaagagaaaaagatagcaagtagaagcagagaacaggatcattggaagggacctgagaaattgccatttcatccattttagcaaatttaattagcatagcatgtaccagtactaggatcttgagtgagtgtgtgagtttagctctgcctaatatattactacttgggggatctttgggagactatatcttcttggagattgagtttcttctataaaataagcataatgctaccctaaatgtaagggttatcatgaagataaataataaaggactacaaaggaccaagcaaataggaattattttttgcggtggagaaacaagtgcctggggagaatatatgaccgaagattctgtagtttatgacttaaacaggcccagaatttagtttttcaaatcctagtagtgtgttttttctgtcttgccaaaaagcagcacacctcaaagaagggaaaaggtgtgaattgtgggtatattagggttattagtgcttccgagggaagataggcatcactacttcccagagatgcccctggaaatgatatagaggatgttgaagaattcaatgtgatgacggaatgaggcatttgtagtaatgctgagaacagaaaaatggactaagtggaaaatttgtaagcatgactttgaatgtagatttgttatgtgaacaaactacctagtttatttttagttcaatacaataattgttttaagaaaacatgaaataactactcaatataaaatgcattttaaaactgtaaataagtcaaaactttattctttttatcataatggtcactagctgagtcacaaatactagtacactcttctgagccatcttctttattcatatctacattgtgtggttaggcatctgttatgtggtgtcacatgataaaataaagaacttcttcccataccaaaaaaaaatcc

SEQ ID NO: 9525 - DNA, 1099 bp, Homo sapiens
  misc_feature (709)..(709): n is a, c, g, or t
  misc_feature (735)..(736): n is a, c, g, or t
  misc_feature (752)..(752): n is a, c, g, or t
  misc_feature (769)..(770): n is a, c, g, or t
  misc_feature (783)..(783): n is a, c, g, or t
gcatgctccgggtgtcccgagagttgtcctgcgccggtgttcccacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgctcgtaaagatgaaaagctgctgtcgtttctaaaagatgtgtatgttgattccaaagatcctgtgtcttccttgcaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaagaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaaaaaaanaaaaaaaaaaaaaaaaaaacaagagnncaatataaaaaaacgnggactctaacaaaaagnncataaaaaatgtntatgaggaaggtgccccccttctggaagccgcctcctattcaaggcttttgggggtcttgttctacacaagactaatttgggtacccttgggggggcccccccatggaaaactttcatttttatacccgagaacgttttttggtaggcaccgtataaaatctattgggcgggaaccaaaatttttgggagggattatcagcacccggcgcgtggttgaaaaaccagggagggggaaacaccccttcctggccccataataaccgggtatttctatcttcccttttggcccgtggtttaaaccaatctcccggttta

SEQ ID NO: 9526 - DNA, 4573 bp, Homo sapiens
  misc_feature (2842)..(2842): n is a, c, g, or t
cccattccttgcccagttacacagcactactggacctcagtcacaacaacctgagccgcctgcgggccgagtggacccccacgcgcctgacccaactgcactccctgctgctgagccacaaccacctgaacttcatctcctctgaggccttttccccggtacccaacctgcgctacctggacctctcctccaaccagctgcgtacactggatgagttcctgttcagtgacctgcaagtactggaggtgctgctgctctacaataaccacatcatggcggtggaccggtgcgccttcgatgacatggcccagctgcagaaactctacttgagccagaaccagatctctcgcttccctctggaactggtcaaggaaggagccaagctacccaaactaacgctcctggatctctcttctaacaagctgaagaacttgccattgcctgacctgcagaagctgccggcctggatcaagaatgggctgtacctacataacaaccccctgaactgcgactgtgagctctaccagctgttttcacactggcagtatcggcagctgagctccgtgatggactttcaagaggatctgtactgcatgaactccaagaagctgcacaatgtcttcaacctgagtttcctcaactgtggcgagtacaaggagcgtgcctgggaggcccacctgggtgacaccttgatcatcaagtgtgacaccaagcagcaagggatgaccaaggtgtgggtgacaccaagtaatgaacgggtgctagatgaggtgaccaatggcacagtgagtgtgtctaaggatggcagtcttcttttccagcaggtgcaggtcgaggacggtggtgtgtatacctgctatgccatgggagagactttcaatgagacactgtctgtggaattgaaagtgcacaatttcaccttgcacggacaccatgacaccctcaacacagcctataccaccctagtgggctgtatccttagtgtggtcctggtcctcatatacctatacctcaccccttgccgctgctggtgccggggtgtagagaagccttccagccatcaaggagacagcctcagctcttccatgcttagtaccacacccaaccatgatcctatggctggtggggacaaagatgatggttttgaccggcgggtggctttcctggaacctgctggacctgggcagggtcaaaacggcaagctcaagccaggcaacaccctgccagtgcctgaggccacaggcaagggccaacggaggatgtcggatccagaatcagtcagctcggtcttctctgatacgcccattgtggtgtgagcaggatgggttggtggggagattctgccccaggagaggtaatgcacccctgaaggatatgaggggatggaagagagggctggctgcccaagggaatggattcctcctgacctcaagggaattggtcccaggtacaacagagagcaagaccccaaacagggcgtggctgccacgattttcaaatgggggtatattaatcctcaggcaaatgctacacccgtacccaaagccctgccaattctcagtgtggtagaggaagagaagcatgtctgagttggatgggaatgaggaaggagtgaggggaagaacagattccctaaactttcatgaggtcatccctagctccttaagagaaaaacatttagaaaaaaaaattttttctatctctgcccacccacacctgtgatgttgtgtgtgttgggggagcttccacaggagccacactggggaaaagctgtagtatcttctttgtttagcaagtcaaacttcacagctggggaagttgaaaacctttggaaaatgagtcaggaaaaggctgagacctcaatcggtaacaattccccaaagctgttgtaagactttgcattaaagccttcctttttcctgatgtgccctgggtggatggatctttgcaggagcctggcctgctgccttttagttacaacagcaatgtgggatgtggtatctgtgccttgtcctgggaccaatggcacagagggttatagcatgaactgaagggtccatgtcacagcataggtgccagcacgaaacttgtagatggggggtgaattccagataggctaattccctggttggtgaaacccttggttagtatttgattcccagcatctgtgtgtcaggccagagtgggggctgctgaaggcagagcttttatggatgcctgccacagacgtggtacatgggcccacttcacgatagaaggatgaaggtaaatcagcctctattatgtagcatccagctggacctagctgattctcaatgtatgccatctcttcatccagtctccttatcaagctcaggtgggattctgaattttccctaatatgctgctctgtaaagggaggagtccaagaaagcctggccccagctggcttagagtaggcttggcgatagtgaaaatccagtatatatctcctctgtgtggacaaggttgccttgctcctctcagagataccacctctgctgcaaagtcaaagcatggggttttgacatcagaagggttggaattgggtggtctctaccccagaatggcaatttggagtgcagcttcaagttctgccctctccacagattccaggcaatcctgaagcagagataatcagtagtactaaactttcagaaggggagttctgccaccccattcctccatcgagaggtctttgcagttgtggttgtgaggccagaggaacttaagaagaatgagctcaacattccattccatccaaggttgcagaatactttgagtatggagatgaccgatccctttaacctttccctttgactanactgcatgccctgtgagtggctgctctgagctttggcgggggatgagcagggtgaaggtgaaaatgttctctgatgttggtttttcttagtgtctcttctctcccacgtttctagtccattggaagttctccagatcctctagatttctgacctctttttacattctaagaggtgtcatttacctgtgggtgaggggcttggagggcctgactattaagcttcctattatgattggggaaggggactcaacatcttccccttgtctggtcctgggaactcaagactgctgtccatcctttattagtaacctagttttgttgagagagaggtgcagcatttccctcaagtacctgcatgctcataggtatgcatgcttataggtatgcatgcacaccagcaccttgacttccaccaggacagtgaatctgtagtccccattaatgatactctcagaatggtctccaccaatgtgcacaacttcatgcacacaattgtattcctctttaggagagacagtgaccatgccaggctcttcaaatacacactcctgtattttcatttctgaactccctgaagcttcacccacatctccatggcactgaatcacttttctgcccaggctggagttagaagaaccatgggttgaaggccttgggagaagaggtggtaaggagctacctgggttctttggactcctcaggaaacctccccgtggaagactatatatatgagcaatatatgagcaattaagatagaactaggtcattgaaggactcagaaggaaactggcaaggggctaagtagctgtgagctgctcttcctgttaactgtcctcaggagagaaaagttgtcttgatttattccagagactcctgagaattttgttactggagctataggaactaggactccctcctcagactcatcaggaaatctgggaaaatctcatctccatgctgcagtctccccgcttggcaccatctagggctctgaagatctttaaagtgagcgttaaatgaagcaggccttctggggcatcgtgatggagctcctgaggactgggagggccgttttcttcataattcctacccagtttagggaatgagaaaaggccctgtggctcttaagtctcctgactatatccactagtttggccttgagtttgagacacctggtagatgtacctggctgccctaccaagagatttgatttgtttcttcccgtggtttcaggtgatagaacccaaaggtagctttttaattggagaattgaataatcagcatatgtaagcgcactagaaccctgtgttgaaaactgccaggtgtgggtataagaaaaggccgagagatcaccacctcctcttaccctaccccacacccataaaccagacatgtctcccaggaagcaggtgtccctggagacagaggatgacagggctctacaatctgtgtaattattattattattattattttgtatttatggggcccaagaaaggggccaggagagggtacaccccagctggggagagcaaagcagatggatccagttttctgtgtgttcttacctctgtacttcctcgtagctctgctgacaaagcaagcaggcctcccgtgtccaagaccccattcctcccacttgtgtacacctaggctggcaaatcttggagcctctgggctctgaaaactagacaatgatcattaaacctggcttgagtctctgttctggca

SEQ ID NO: 9527 - DNA, 1553 bp, Homo sapiens
  misc_feature (31)..(31): n is a, c, g, or t
aaggctaggtacgaggctggtgttaatcggncgaggattagcttcctattatgattggggaaggggactcaacatcttccccttgtctggtcctgggaactcaagactgctgtccatcctttattagtaacctagttttgttgagagagaggtgcagcatttccctcaagtacctgcatgctcataggtatgcatgcttataggtatgcatgcacaccagcaccttgacttccaccaggacagtgaatctgtagtccccattaatgatactctcagaatggtctccaccaatgtgcacaacttcatgcacacaattgtattcctctttaggagagacagtgaccatgccaggctcttcaaatacacactcctgtattttcatttctgaactccctgaagcttcacccacatctccatggcactgaatcacttttctgcccaggctggagttagaagaaccatgggttgaaggccttgggagaagaggtggtaaggagctacctgggttctttggactcctcaggaaacctccccgtggaagactatatatatgagcaatatatgagcaattaagatagaactaggtcattgaaggactcagaaggaaactggcaaggggctaagtagctgtgagctgctcttcctgttaactgtcctcaggagagaaaagttgtcttgatttattccagagactcctgagaattttgttactggagctataggaactaggactccctcctcagactcatcaggaaatctgggaaaatctcatctccatgctgcagtctccccgcttggcaccatctagggctctgaagatctttaaagtgagcgttaaatgaagcaggccttctggggcatcgtgatggagctcctgaggactgggagggccgttttcttcataattcctacccagtttagggaatgagaaaaggccctgtggctcttaagtctcctgactatatccactagtttggccttgagtttgagacacctggtagatgtacctggctgccctaccaagagatttgatttgtttcttcccgtggtttcaggtgatagaacccaaaggtagctttttaattggagaattgaataatcagcatatgtaagcgcactagaaccctgtgttgaaaactgccaggtgtgggtataagaaaaggccgagagatcaccacctcctcttaccctaccccacacccataaaccagacatgtctcccaggaagcaggtgtccctggagacagaggatgacagggctctacaatctgtgtaattattattattattattattttgtatttatggggcccaagaaaggggccaggagagggtacaccccagctggggagagcaaagcagatggatccagttttctgtgtgttcttacctctgtacttcctcgtagctctgctgacaaagcaagcaggcctcccgtgtccaagaccccattcctcccacttgtgtacacctaggctggcaaatcttggagcctctgggctctgaaaactagacaatgatcattaaacctggcttgagtctctgttctggca

SEQ ID NO: 9528 - DNA, 4955 bp, Homo sapiens
  misc_feature (2842)..(2842): n is a, c, g, or t
cccattccttgcccagttacacagcactactggacctcagtcacaacaacctgagccgcctgcgggccgagtggacccccacgcgcctgacccaactgcactccctgctgctgagccacaaccacctgaacttcatctcctctgaggccttttccccggtacccaacctgcgctacctggacctctcctccaaccagctgcgtacactggatgagttcctgttcagtgacctgcaagtactggaggtgctgctgctctacaataaccacatcatggcggtggaccggtgcgccttcgatgacatggcccagctgcagaaactctacttgagccagaaccagatctctcgcttccctctggaactggtcaaggaaggagccaagctacccaaactaacgctcctggatctctcttctaacaagctgaagaacttgccattgcctgacctgcagaagctgccggcctggatcaagaatgggctgtacctacataacaaccccctgaactgcgactgtgagctctaccagctgttttcacactggcagtatcggcagctgagctccgtgatggactttcaagaggatctgtactgcatgaactccaagaagctgcacaatgtcttcaacctgagtttcctcaactgtggcgagtacaaggagcgtgcctgggaggcccacctgggtgacaccttgatcatcaagtgtgacaccaagcagcaagggatgaccaaggtgtgggtgacaccaagtaatgaacgggtgctagatgaggtgaccaatggcacagtgagtgtgtctaaggatggcagtcttcttttccagcaggtgcaggtcgaggacggtggtgtgtatacctgctatgccatgggagagactttcaatgagacactgtctgtggaattgaaagtgcacaatttcaccttgcacggacaccatgacaccctcaacacagcctataccaccctagtgggctgtatccttagtgtggtcctggtcctcatatacctatacctcaccccttgccgctgctggtgccggggtgtagagaagccttccagccatcaaggagacagcctcagctcttccatgcttagtaccacacccaaccatgatcctatggctggtggggacaaagatgatggttttgaccggcgggtggctttcctggaacctgctggacctgggcagggtcaaaacggcaagctcaagccaggcaacaccctgccagtgcctgaggccacaggcaagggccaacggaggatgtcggatccagaatcagtcagctcggtcttctctgatacgcccattgtggtgtgagcaggatgggttggtggggagattctgccccaggagaggtaatgcacccctgaaggatatgaggggatggaagagagggctggctgcccaagggaatggattcctcctgacctcaagggaattggtcccaggtacaacagagagcaagaccccaaacagggcgtggctgccacgattttcaaatgggggtatattaatcctcaggcaaatgctacacccgtacccaaagccctgccaattctcagtgtggtagaggaagagaagcatgtctgagttggatgggaatgaggaaggagtgaggggaagaacagattccctaaactttcatgaggtcatccctagctccttaagagaaaaacatttagaaaaaaaaattttttctatctctgcccacccacacctgtgatgttgtgtgtgttgggggagcttccacaggagccacactggggaaaagctgtagtatcttctttgtttagcaagtcaaacttcacagctggggaagttgaaaacctttggaaaatgagtcaggaaaaggctgagacctcaatcggtaacaattccccaaagctgttgtaagactttgcattaaagccttcctttttcctgatgtgccctgggtggatggatctttgcaggagcctggcctgctgccttttagttacaacagcaatgtgggatgtggtatctgtgccttgtcctgggaccaatggcacagagggttatagcatgaactgaagggtccatgtcacagcataggtgccagcacgaaacttgtagatggggggtgaattccagataggctaattccctggttggtgaaacccttggttagtatttgattcccagcatctgtgtgtcaggccagagtgggggctgctgaaggcagagcttttatggatgcctgccacagacgtggtacatgggcccacttcacgatagaaggatgaaggtaaatcagcctctattatgtagcatccagctggacctagctgattctcaatgtatgccatctcttcatccagtctccttatcaagctcaggtgggattctgaattttccctaatatgctgctctgtaaagggaggagtccaagaaagcctggccccagctggcttagagtaggcttggcgatagtgaaaatccagtatatatctcctctgtgtggacaaggttgccttgctcctctcagagataccacctctgctgcaaagtcaaagcatggggttttgacatcagaagggttggaattgggtggtctctaccccagaatggcaatttggagtgcagcttcaagttctgccctctccacagattccaggcaatcctgaagcagagataatcagtagtactaaactttcagaaggggagttctgccaccccattcctccatcgagaggtctttgcagttgtggttgtgaggccagaggaacttaagaagaatgagctcaacattccattccatccaaggttgcagaatactttgagtatggagatgaccgatccctttaacctttccctttgactanactgcatgccctgtgagtggctgctctgagctttggcgggggatgagcagggtgaaggtgaaaatgttctctgatgttggtttttcttagtgtctcttctctcccacgtttctagtccattggaagttctccagatcctctagatttctgacctctttttacattctaagaggtgtcatttacctgtgggtgaggggcttggagggcctgactattaagcttcctattatgattggggaaggggactcaacatcttccccttgtctggtcctgggaactcaagactgctgtccatcctttattagtaacctagttttgttgagagagaggtgcagcatttccctcaagtacctgcatgctcataggtatgcatgcttataggtatgcatgcacaccagcaccttgacttccaccaggacagtgaatctgtagtccccattaatgatactctcagaatggtctccaccaatgtgcacaacttcatgcacacaattgtattcctctttaggagagacagtgaccatgccaggctcttcaaatacacactcctgtattttcatttctgaactccctgaagcttcacccacatctccatggcactgaatcacttttctgcccaggctggagttagaagaaccatgggttgaaggccttgggagaagaggtggtaaggagctacctgggttctttggactcctcaggaaacctccccgtggaagactatatatatgagcaatatatgagcaattaagatagaactaggtcattgaaggactcagaaggaaactggcaaggggctaagtagctgtgagctgctcttcctgttaactgtcctcaggagagaaaagttgtcttgatttattccagagactcctgagaattttgttactggagctataggaactaggactccctcctcagactcatcaggaaatctgggaaaatctcatctccatgctgcagtctccccgcttggcaccatctagggctctgaagatctttaaagtgagcgttaaatgaagcaggccttctggggcatcgtgatggagctcctgaggactgggagggccgttttcttcataattcctacccagtttagggaatgagaaaaggccctgtggctcttaagtctcctgactatatccactagtttggccttgagtttgagacacctggtagatgtacctggctgccctaccaagagatttgatttgtttcttcccgtggtttcaggtgatagaacccaaaggtagctttttaattggagaattgaataatcagcatatgtaagcgcactagaaccctgtgttgaaaactgccaggtgtgggtataagaaaaggccgagagatcaccacctcctcttaccctaccccacacccataaaccagacatgtctcccaggaagcaggtgtccctggagacagaggatgacagggctctacaatctgtgtaattattattattattattattttgtatttatggggcccaagaaaggggccaggagagggtacaccccagctggggagagcaaagcagatggatccagttttctgtgtgttcttacctctgtacttcctcgtagctctgctgacaaagcaagcaggcctcccgtgtccaagaccccattcctcccacttgtgtacacctaggctggcaaatcttggagcctctgggctctgaaaactagacaatgatcattaaacctggcttgagtctctgttctggcaaaaaaaaaaaaaaaaaaaaaaaaaaaaaaaaaaaaaaaaaaaaaaaaacaaaaaaaaaaacaaaaaagaaaaacaacaaaaaagaagagggggggcgcgcgcgcaataaatgcccccgggggggggcacacaattaccagcgacaccacaggttcgagacaaacgggcccccacaaagaggcgagcgcactatacaaaggccagcaagcaggcggggcacgacgtgaaaaaacacgcacgggcgagtgacggggcaaacaacggtcgcgagcgggcagacactggtggagaaagaccacccactcacgcgacgggggggaggcagaacaaacgggggaaaaagatcagcacagaacaacttcagacgcccggagacgaaaaa

SEQ ID NO: 9529 - DNA, 689 bp, Homo sapiens
acaaaatttccattccttggtgacccattctaaagcaaagtagtctaaaaattaaattcattctaaggtttgattgttcggtaactactcctggggaaaaaactgcatttaaaagagaaagactaaaatatatttttacctaggtaacccaaagtgacaaaccttcagtggagggatgttgaatagaagaggtatgtttatcttggaggcacgtgattttctggctactgcttaatcttacccctagcaagcaacgttattctacacagactttctcctatatggtgagagaattaacacaatccgaggcctgagaaccagagagtgcatccttgactctaatggctgcactattgctcccatagttttgttcctgaagatgcattttaggaagagccttatgaatagcttgatcattaccagaataaagtgtctatctcaactagagcctaatacaaaaaagaaaaagaaaaacgatatcctgttctaaataaaactgctgtttggtaccagttgtagaaatgagggctactggtctccttatctcaggtgggacataagtgtgtgatagagcgtctttcctcagatgaggcagtatcctgcttcaatgaacgtacccacactgtccccacattttccctcttagtcttcccaataaaaggagaagcctatttaggaagaaacagaca

SEQ ID NO: 9530 - DNA, 385 bp, Homo sapiens
tgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatgg

SEQ ID NO: 9531 - DNA, 753 bp, Homo sapiens
aattgctttgaacccaggaggcagaggttgcagtaagccaagatcgtgccactgtgctccaacctgggagacagggagtaagccctctcgcaagcaatgattgcattacttgattccatctatgaataggcctcaataagactaaatcccgtgtacaattccttggggacatgcgcgctccaccttggcccacaaagggggttttcttatcttttttcctctttcaaagtaatgatagtctatggttgccctactatgtattctctttttattattttattatttttttttttagagacagggtctcactctgttatccaggctggagtgcagtggtgcaattatagctcactgcagccttggcctcctgggctcacgcggtcatcccacctcagcctcctgcatagctaggatcacaggcatgcccccatcatgctcagctaatttaaaaaatattttttttgaggctgggcacagtggttcatgcctttaatcccagaactttgagaggctgaggcgggaggattgattgggtccaggagttcaagaacctgagaaatacagagagaccccatttttactacaaaaaaatagaatcaaaaaattagccaggcccagtggcattcacctgtagtcccagctacttatgaggctgaggcagaggattgcttgaacccaggggttcaaggcaaattgagctatgattgggcactgcacttagctttggtgacacggcaagactctgtctccatt

SEQ ID NO: 9532 - DNA, 583 bp, Homo sapiens
  misc_feature (44)..(44): n is a, c, g, or t
ttcccgggtcgactactactactaaattgcggccgcgtcgacantgtgcatgatgtattttacgtagtactctgaggaagtctctttataaaacctactaccacttagtataaatttgtttgaatttatatcatttgttactgtaaattcagcttattccaattaggttggcacagatttaaactgatacacattccacaaaaaccaattcagtgtataagtattgaagtataagcagtcattgcagcttgatgccagatcatgtatgtaataacaagtggaagttaatagggccttctaatactgtatgggtactcctaagaattatttcattttggatataaagaagttatgaggcctcctgtcacattcacagctggttctccaaaataatttggttgtttcaaaaacaaatggtaatcatttggttggattcttcagtatcatgactagatcatgtggttttaccatagttgccaagtggtgggaggtagcatacctgaaaatgtacgtgtgtgtttgttgtattttttcacattttgtgaacaaagcacatttattaaaaattttaaattttctagta

SEQ ID NO: 9533 - DNA, 471 bp, Homo sapiens
  misc_feature (44)..(44): n is a, c, g, or t
ttcccgggtcgactactactactaaattgcggccgcgtcgacanaagacaagattagtttaaacagttaagaacatttagtccacattgtcttgtcagccagcaattgtcatggaagctatcatttttaagagtgccactgtgtggatttttttttcaagtggttattacattaaaattacctcatactgaggtttttgcactgaaatatcacagtttcagatttcatggttaatgttgtgcgtatgtttgtatgtttttaaaggaaacttgcattttcaatagttgatcctaaatttcataaactgcacttctttactctggtaaagctgatgtttttgtgcttattgtgaattgccgtagtacctttgaatgtcaaactttatttagaaatataaaacttatcctttatgatataaatggttgagtgtatgtacccagtatttctaattaaatttcacatgctaaatta

SEQ ID NO: 9534 - DNA, 3835 bp, Homo sapiens
ggcggcggcggcggctgcgatatggagccaggggccggcggccgaaatactgctcgtgcgcagagggccgggtccccgaacactccgccgccccgggagcaggagcggaaactggagcaggagaagctctccggtgtggtgaagagcgtccaccggcggctccgcaagaagtaccgagaagtgggagattttgataagatctggcgagaacactgtgaggatgaagaaactctttgtgaatatgccgttgcaatgaaaaatttggcagataatcattgggcaaaaacttgtgagggcgaaggtcgtattgaatggtgttgtagtgtatgcagagaatatttccaaaatggtgggaagagaaaagcacttgagaaagatgaaaaaagagctgtacttgccactaagaccactccagccttaaatatgcatgagtcttctcaacttgaaggtcatttaaccaacctcagctttacaaaccctgaatttataactgagttgctacaagcctcaggaaaaatcagattacttgatgttggcagctgctttaacccatttctgaagtttgaagaatttctaactgttggcatagatattgtacctgctgtagagagtgtctataaatgtgatttcctgaacttacagcttcagcaaccactccagcttgcacaggatgctatagatgcttttttgaagcagctgaaaaaccctattgattctcttcctggagagcttttccatgtggttgttttctctctccttctttcttattttccatctccttaccagcgatggatttgctgcaagaaagcccatgaactgttagtgttaaatggtttattactaatcatcacacctgattcctcccatcagaaccgtcatgctatgatgatgaaaagctggaagattgctatagagtccctgggctttaaacgcttcaagtactcaaaattttcacatatgcatctgatggcatttaggaaaatctctctaaaaaccacaagtgacttggttagtaggaactacccaggaatgttatatattcctcaagatttcaacagtatagaagatgaggaatattctaacccttcctgctatgttcgatcagatatagaagatgaacaactagcatatggtttcacagaactccctgatgcgccatatgactcagattctggagaaagtcaagccagctctattcctttctatgagctagaagaccccatattacttttaagttaatatagaagcaaaaagcccctttcagtccaggctcctaaactaattgcttacaccaattggaaatactaacatgaactcagtactgaaaacctggtttgcataaaagaaatgcagaggtttacagagtttgctatttttttctacttctcaattttaaaatttattcttatatagaaagcttaaagtttcatgcagagtgactcatgtcatagcagaaactactgttactttagcatttagcactatcatagaaaggtacctttttctctttagtgctattgtgaaaacaagcataatttgctatatgttttccttttcaacttttcagtgttgactataaaccattgaatggaaaactttaagatgtagaaagctgtagattgcactttgatgactcacaagttaaatgtgatacagaaaaatagatcggttagttgttttgtgatgcacttatctttttcttttttctaactaaaattgtgatgttacagaaagtcattttatgttccttttttgtctgatgatccaatatttactgaactttttgtaattggtgataattctttttatttcttccttatattaaaagctcatttgacagcatcagacattgggggagagatgtcccccaaagtgtgtattctaattttattagccctatccaataaacaccattgccaaagtagtattttcataactttcttgttgatttgggccttggtgtgaagtatatttacctgagagttcacttttacttttcttaaacttaggcttcatttacaaaatgttttatttaagcaaggaacaatgtaatactcaataatgacctaaaacacctttttgaaagggtttgcacttggaagagagtttatgttctgttgaaaccaactttgatagggtcctcacctttccgttaaggaggtgccgcactacaagtttcaaattatatggaaaaacctaaaattaaccctctgttggtgatctcataaaatggttttgaccttttggtatcttaatttctatctaaactttatcagaaaattttctttgaatatatcaattagttggctgtgggaattttccctttccacattaataaatgcctttctgtgtttctgaatcagaagcaaatgattagggaaaaatatatgtccaaacaagacaagattagtttaaacagttaagaacatttagtccacattgtcttgtcagccagcaattgtcatggaagctatcatttttaagagtgccactgtgtggatttttttttcaagtggttattacattaaaattacctcatactgaggtttttgcactgaaatatcacagtttcagatttcatggttaatgttgtgcgtatgtttgtatgtttttaaaggaaacttgcattttcaatagttgatcctaaatttcataaactgcacttctttactctggtaaagctgatgtttttgtgcttattgtgaattgccgtagtacctttgaatgtcaaactttatttagaaatataaaacttatcctttatgatataaatggttgagtgtatgtacccagtatttctaattaaatttcacatgctaaattaatgaaagtaacaagattgtaattttttaaagtcagttgattaaatgcaataaatatggttgctcaaatatgccacaaataactcgaaatttttcatttactttcaacagcataagattctttaatatttaggattgactgttctttccagttaagcactgaaggattatgtcttgtagcttccccaagagaaggggaaggaaaaaaaagcactatgttaaggataatacagaactcttttgaactattttggtagtaccttttaccatactgtttgctttttgatttgggtaaatatcttaagagcaaagaaaacaatacaccaaatgaaaatgctttgaaagtaaatgaaaacagcgcttttgaaaggctggtatagtatgaccctggagtcagcctttgtgttacagcgaaaatgttggtgctataaattctgattgtttacagatgttgattctgcttatgctccaaagtgtgcatgatgtattttacgtagtactctgaggaagtctctttataaaacctactaccacttagtataaatttgtttgaatttatatcatttgttactgtaaattcagcttattccaattaggttggcacagatttaaactgatacacattccacaaaaaccaattcagtgtataagtattgaagtataagcagtcattgcagcttgatgccagatcatgtatgtaataacaagtggaagttaatagggccttctaatactgtatgggtactcctaagaattatttcattttggatataaagaagttatgaggcctcctgtcacattcacagctggttctccaaaataatttggttgtttcaaaaacaaatggtaatcatttggttggattcttcagtatcatgactagatcatgtggttttaccatagttgccaagtggtgggaggtagcatacctgaaaatgtacgtgtgtgtttgttgtattttttcacattttgtgaacaaagcacatttattaaaaattttaaattttctagta

SEQ ID NO: 9535 - DNA, 2824 bp, Homo sapiens
ggcggcggcggcggctgcgatatggagccaggggccggcggccgaaatactgctcgtgcgcagagggccgggtccccgaacactccgccgccccgggagcaggagcggaaactggagcaggagaagctctccggtgtggtgaagagcgtccaccggcggctccgcaagaagtaccgagaagtgggagattttgataagatctggcgagaacactgtgaggatgaagaaactctttgtgaatatgccgttgcaatgaaaaatttggcagataatcattgggcaaaaacttgtgagggcgaaggtcgtattgaatggtgttgtagtgtatgcagagaatatttccaaaatggtgggaagagaaaagcacttgagaaagatgaaaaaagagctgtacttgccactaagaccactccagccttaaatatgcatgagtcttctcaacttgaaggtcatttaaccaacctcagctttacaaaccctgaatttataactgagttgctacaagcctcaggaaaaatcagattacttgatgttggcagctgctttaacccatttctgaagtttgaagaatttctaactgttggcatagatattgtacctgctgtagagagtgtctataaatgtgatttcctgaacttacagcttcagcaaccactccagcttgcacaggatgctatagatgcttttttgaagcagctgaaaaaccctattgattctcttcctggagagcttttccatgtggttgttttctctctccttctttcttattttccatctccttaccagcgatggatttgctgcaagaaagcccatgaactgttagtgttaaatggtttattactaatcatcacacctgattcctcccatcagaaccgtcatgctatgatgatgaaaagctggaagattgctatagagtccctgggctttaaacgcttcaagtactcaaaattttcacatatgcatctgatggcatttaggaaaatctctctaaaaaccacaagtgacttggttagtaggaactacccaggaatgttatatattcctcaagatttcaacagtatagaagatgaggaatattctaacccttcctgctatgttcgatcagatatagaagatgaacaactagcatatggtttcacagaactccctgatgcgccatatgactcagattctggagaaagtcaagccagctctattcctttctatgagctagaagaccccatattacttttaagttaatatagaagcaaaaagcccctttcagtccaggctcctaaactaattgcttacaccaattggaaatactaacatgaactcagtactgaaaacctggtttgcataaaagaaatgcagaggtttacagagtttgctatttttttctacttctcaattttaaaatttattcttatatagaaagcttaaagtttcatgcagagtgactcatgtcatagcagaaactactgttactttagcatttagcactatcatagaaaggtacctttttctctttagtgctattgtgaaaacaagcataatttgctatatgttttccttttcaacttttcagtgttgactataaaccattgaatggaaaactttaagatgtagaaagctgtagattgcactttgatgactcacaagttaaatgtgatacagaaaaatagatcggttagttgttttgtgatgcacttatctttttcttttttctaactaaaattgtgatgttacagaaagtcattttatgttccttttttgtctgatgatccaatatttactgaactttttgtaattggtgataattctttttatttcttccttatattaaaagctcatttgacagcatcagacattgggggagagatgtcccccaaagtgtgtattctaattttattagccctatccaataaacaccattgccaaagtagtattttcataactttcttgttgatttgggccttggtgtgaagtatatttacctgagagttcacttttacttttcttaaacttaggcttcatttacaaaatgttttatttaagcaaggaacaatgtaatactcaataatgacctaaaacacctttttgaaagggtttgcacttggaagagagtttatgttctgttgaaaccaactttgatagggtcctcacctttccgttaaggaggtgccgcactacaagtttcaaattatatggaaaaacctaaaattaaccctctgttggtgatctcataaaatggttttgaccttttggtatcttaatttctatctaaactttatcagaaaattttctttgaatatatcaattagttggctgtgggaattttccctttccacattaataaatgcctttctgtgtttctgaatcagaagcaaatgattagggaaaaatatatgtccaaacaagacaagattagtttaaacagttaagaacatttagtccacattgtcttgtcagccagcaattgtcatggaagctatcatttttaagagtgccactgtgtggatttttttttcaagtggttattacattaaaattacctcatactgaggtttttgcactgaaatatcacagtttcagatttcatggttaatgttgtgcgtatgtttgtatgtttttaaaggaaacttgcattttcaatagttgatcctaaatttcataaactgcacttctttactctggtaaagctgatgtttttgtgcttattgtgaattgccgtagtacctttgaatgtcaaactttatttagaaatataaaacttatcctttatgatataaatggttgagtgtatgtacccagtatttctaattaaatttcacatgctaaatta

SEQ ID NO: 9536 - DNA, 301 bp, Homo sapiens
ctggttatctttccagctgtctccggtgactatggaaatgagataaggacattccaagatggatgctgcccctcttcaagccaactttcctctaggctaatattttagatcaacactgggtttgctggggtgggggtgtaggagtctcctttcaggaaactcagtaggttgaacaaattccggtcacattccccctccagggcagatgcagtctccccgcaaaagtcagctccctggtccttctgtttggtgcccccactacttccactgccagaataaatcattccgcatatttgtataa

SEQ ID NO: 9537 - DNA, 969 bp, Homo sapiens
gcactttggtcgtgggcgcgtgtgtggaatgggaggaggtcgcgctgtccatgggcgtccttggcctgcgccacccagagatgataaatagccaaagacgtcaatggcacccatggacatagtaagcatagtaggagctgaaaaactagaagcaatgacaatgtcaactattttgagcaaaaagaagcagtgtcttcggaacatttgatcataaaaccagaaattaaaggatgagaaaaacatttttctgaagcttatactttcacatttcctagagagcatatttgtgtggatgggggtgggtaaacactcaacaaaagtttctttaaaaagaagaaaccatcctggtttgatgtaatcaatggttgcccactgctcccttcctgtgcctgtgacccttcccaaactgccctgttgcttgcaggctcgcctgagctgaaaggcagccctcacatcccgtcggcacctccctggggccttctttacaccctggagaacttcacagggaatctgtgtctgtaacacaaaggcttcctggtccagatgtagatactaaggctgactggttatttaagtcctgcggacttactctgccaaaattatttaatcatgtaaaaataatttataattcttataaagtatccccttcataatataatgaatgttggtgctattacatttaagtgcacatgtacagtatacaagattattaataataatgttttcaaatagttattgtcaaagctatttttcttatgtttatgaaagtgcttataaaattcatgttttatgaggctggagatgtatattttgtaatttcattctgatatttgttaatattcgcttccaatgctggttttgtttgatgagactgacattgcctaatttcaagctttttgaatgtgtattctttcagggcaagtatgaaataactagtaaaaaatatacaaatatgcttaacaataagta

SEQ ID NO: 9538 - DNA, 958 bp, Homo sapiens
gcactttggtcgtgggcgcgtgtgtggaatgggaggaggtcgcgctgtccatgggcgtccttggcctgcgccacccagagatgataaatagccaaagacgtcaatggcacccatggacatagtaagcatagtaggagctgaaaaactagaagcaatgacaatgtcaactattttgagcaaaaagaagcagtgtcttcggaacatttgatcataaaaccagaaattaaaggatgagaaaaacaaaaaaaaaaaaaaaaaaaaaaaaacctttttgcggccgcctgtgggccctgagaaaaaggttttctaaaacacccttcggtttgggggggcgggggccccggttggtttaggggccccccgtgggcccaaaaccgttggtccacataagagagaatcccgggcagatgacacataggtggttggggttctcaccaaattaaaaagacggccgggcggggaaccggagcgttctggaacacaattccgaaattggaggtccgggagggcacataacggggtcctaaatacacgggggtgtcaacgcgaacgccgattataaaaattagcccgcgccgtggtggaaacacacatagcaaagcaggccgagcaacacaaggacaagacagcgaaagagagaaagaggaagcggagagtggaagacggataagcacgatacaaacaactctaatcgcaaaagaaagaaaagaaaaagaacagaaaaagtaccaaacagaacaaaaaaaaagaccagccaacaacaacacacacactactctcactaaataacaaacgcatatagcgacaacttgaacgacaaacaataaataaaaacgacacaagacaatgacataacagtcagtacgaatacaaaatcacacagaagcagttaaaataataataagtaaacaactacgaaaacaaacaaagacctaaccataataaacacagacccaac

SEQ ID NO: 9539 - DNA, 1111 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgcca

SEQ ID NO: 9540 - DNA, 755 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagaaggttataacgatggagaggtagatgacgaggaagattaccacacaaaccacaaata

SEQ ID NO: 9541 - DNA, 598 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaacttatttttttctgattgtaacgttgctgtgggaacgagaggggaagagtgtactgggggttgcggggggagggatggcgggtgggggtggaataaaatactatttttactgcca

SEQ ID NO: 9542 - DNA, 631 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactggtaagtcattcggaccctcccctccctgcaggggtaggaggtgggaggaattggcatcagcaaatactacttttgcatttgtccttttcccacttaatttttttgactctcatgatgtgctatgagatagaattgagctattgtttctgct

SEQ ID NO: 9543 - DNA, 327 bp, Homo sapiens
  misc_feature (38)..(39): n is a, c, g, or t
tgcaggagatacgggggtgcactccccccattcgaacnncgctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9544 - DNA, 433 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcctgaaacttatttttttctgattgtaacgttgctgtgggggtggaataaaatactatttttactgccaaaaaaaa

SEQ ID NO: 9545 - DNA, 629 bp, Homo sapiens
  misc_feature (14)..(14): n is a, c, g, or t
ccggcagtactccngggcgtatgtagcgaggctgggtggcgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggagaggatgaagaaggttataacgatggacgaggtacgatgcacgcggaccgatgaacgaagacgctcgctgaagacgaacacggggtcacgccgcgaacaacgagcagcccctggaaacgactgacgggggacgcaacgaccggccgaccctactgctggacactacagcgtacttacggaagaacgtgccgtgatcagtcgcactcggcacgtgtacagtacaccactgcacggcagacccaccgacacgccaccgccaaacccccgaccaaccccgccccgacccccccct

SEQ ID NO: 9546 - DNA, 484 bp, Homo sapiens
ggcctggcttcctggctctgcgatgctttcctgccctagggcagaaggcctcacaggatttattcccaggcactcttgccatgaccttgagaaggtggcttgacctggacatctggatctcagggactgagggggtgggaaaggactgagcctccccctcccagacccaacaggaaggtgggctttggtgaccatttcctaggctgagagctccttagctccaggagagggctgcgctccctggttctcctgctctgtgggctgtgctagatgaaacccacaaattgctgctgtcccgggcggagtggcatgcctccacccaccagtgaagaatgaaggcagggcagttgcagggccctgcaggactctgagatccagatgtgtaccccagtgctcccctgctctgcccactggcaagaggggatggcgggtgggggtggaataaaatactatttttactgccaaaaaaaaaacaaaacacaca

SEQ ID NO: 9547 - DNA, 185 bp, Homo sapiens
gcggccgcctactactactactactgctcgaattcaagcttctaacgatgtacggggtgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9548 - DNA, 387 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgagcatttgccaaaaatatctctgtcggtccattctcctactttgtgtgtgtgtgtgtgtgtgcgcgctggggggaggcactttttttgggggggggcgcccgggaggtgcgggtttgggggtcggactgcaagcgaattggcaaggctggggggttgcaatgccatccgagcatgtt

SEQ ID NO: 9549 - DNA, 2079 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9550 - DNA, 2456 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatttttttggggatggcttctttgagtccaacaggccattgatcttttcaagatgcattccagatgaactgctaggtgagggggaagcttcatttttgttacctgatagaatagcttttcttatgagatatatataatgtgatactatgtttggatatttttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgtttgtcgtattgtaaaaagaatgtatggttgaaaactcaggaatgtttataaaacaaattatttcacaaaaaaaaag

SEQ ID NO: 9551 - DNA, 2099 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaattaaaaaaaaacaaaacacaca

SEQ ID NO: 9552 - DNA, 2003 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttcgaaattgtacacggtgaagaacatgagaggtgtagaaagggatcctctagaa

SEQ ID NO: 9553 - DNA, 1950 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctctttatgtacattcctcatccgtggga

SEQ ID NO: 9554 - DNA, 2398 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatttttttggggatggcttctttgagtccaacaggccattgatcttttcaagatgcattccagatgaactgctaggtgagggggaagcttcatttttgttacctgatagaatagcttttcttatgagatatatataatgtgatactatgtttggatatttttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgtttgtcgtattgtaaaaagaatgtatggttgaaaactcaggaatgtttataaaacaaattatttcacaaaaaaaaag

SEQ ID NO: 9555 - DNA, 2099 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggtgtctgtcctttctcctaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9556 - DNA, 2086 bp, Homo sapiens
agcgttcagaggtcccactcagttacacaatcaaagaagcatgtagtttacttttagaaacatacaatgggcccaatatgggaattttcataatagttcatacattgtcagccaacattaaaaggtaaccaactcctcaggtattgtagtttaccctaacgcttctttaaaagaaagtaggtaaaaaaagaaaagggtagataatctttcgtatgcaaacttttcccttatattttgtctttctttcctttttgactttagtagcatcctccacacatttgtgtaaactgattatcagtttacacaaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9557 - DNA, 1777 bp, Homo sapiens
acaggacttcgagttagcgggcactcctcgcatatacaagttaacaacttagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9558 - DNA, 1783 bp, Homo sapiens
ttagaggagctgagggtctcttcctcaatccaaattaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9559 - DNA, 1690 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9560 - DNA, 1717 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9561 - DNA, 1270 bp, Homo sapiens
gagccagagagctgaaaaccgcaggcttggtgaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9562 - DNA, 1432 bp, Homo sapiens
ggcctggcttcctggctctgcgatgctttcctgccctagggcagaaggcctcacaggatttattcccaggcactcttgccatgaccttgagaaggtggcttgacctggacatctggatctcagggactgagggggtgggaaaggactgagcctccccctcccagacccaacaggaaggtgggctttggtgaccatttcctaggctgagagctccttagctccaggagagggctgcgctccctggttctcctgctctgtgggctgtgctagatgaaacccacaaattgctgctgtcccgggcggagtggcatgcctccacccaccagtgaagaatgaaggcagggcagttgcagggccctgcaggactctgagatccagatgtgtaccccagtgctcccctgctctgcccactggcaagaggggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9563 - DNA, 923 bp, Homo sapiens
ggcctaagtcctttgcggtgccttcccactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9564 - DNA, 789 bp, Homo sapiens
ggccctgatcactttagaggcttttaagaaattgtttaaagaagccaatgcctctgagtgaagtgtactatcccctccctgaagccccccggcaccagtcctaccaatttaaaaaggctcgatggcaaaatttctccatcctggaatcccctagggaaggggtccggagaaagtgccctgcttgatatttaagaactcccccgctctttaacataagcacttatccctgacctgccatactgccagatgccagctaaacttatcccgaagtatgtagtcgactacatacttcccaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9565 - DNA, 783 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgataaacagaggaaatattaattaaatgggctgtaaacaataacaactgtgaataagattatcaaatctgttttagtgtaatgattgtcaagtttaaaaacattt

SEQ ID NO: 9566 - DNA, 186 bp, Homo sapiens
tgacttctcactgggtgggttgagttaaagaggtgggattaataactaatctaaatgccgctttcttacttttccagaagaagaaaggggtcagaagcgaaaacgagaacctgaagatgagggagaagatgatgactaagtggaataacctattttgaaaaattcctattgtgatttgactgtttt

SEQ ID NO: 9567 - DNA, 1394 bp, Homo sapiens
ttagaggagctgagggtctcttcctcaatccaaattaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatt

SEQ ID NO: 9568 - DNA, 1422 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggtaaggaggctgggctgggcagggccaccgtctgcccctttgaggcagtcccactgactgcctctgtgatcagtcttggcagccccggagccctggttaggaaagtcgctccccgatgggtagtgaagtgagtccatttcagagcctttcactgggctgtttctggggagacaagacttgcagtaagctctggggaggctggattagaagaggggaagaggattttagaggcagggactgaacctgctggggtaagcctggccgttgtttctatgtgaagaagtacagaatgcatggccccattttctgctttttgctttcatatgctaattaagatattcattgagcacttaaactgtgctagggaaaaccaaagtctgccttgaactgataggtagcaggataacactgctggatcccaaatcagagagtgacactatggaaatagagcaccaggagttggccattttcctaaagagattggctggttcccagttttttaacaagatctgtgagggggtgagtcccagctctaccactcgcaagctgtgtgtccccagacaatttacctgacctttctgagcctatttcttcatctgtaaaatagggatcatgatagctttctcacagggttgttaagaggat

SEQ ID NO: 9569 - DNA, 469 bp, Homo sapiens
gatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtgcgctcgtagagggatcctctaagtagt

SEQ ID NO: 9570 - DNA, 492 bp, Homo sapiens
agatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcaggtaattcgagaaccaggctgcctgggcgccattcacttccccactctctggggggcagggagcatctaaacctttatctgatactctattccctgtggaattgcaaaatggagaaagctgcacgccagccgggagtggtggctcgcgcctgtaatcccagcactttgagaggccaagacgggtgaatcacttgtcaggagttcaagaccagcctagccaacgtggtgaaacctcatctctactaaa

SEQ ID NO: 9571 - DNA, 614 bp, Homo sapiens
gacagtctgaacagtttaagcagactggctgaagctttgcccaaacaatccatggatggaaaagcaccacttgctactggggaggatgatgatgatgaagttcctgatcttgtggagaattttgatgaggcttccaagaatgaggcaaactgaattgagtcaacttctgaagataaaacttgaagaagttactgggagctgctattttatattatgactactttttaagaatttttgtttatggatctgataaaatctagatctctaatatttttaagcccaagccctttggacactgcagctcttttcaggttttgcttatacacaattcattctttgcagctaataaagccgaagaagcctgagaataaactttgaaacaaaggttaataaagttctttgcctagtaaaacaaaacaaaacaaaacaaaacaaaacaaaacaaaacaaaaagcttatatcattaaggccaggcgcagtggctcacacctgtagtcccagcactttgggagaccaaggcaggtggatcacttgagtgcaggagttcaagtacggcttaggcaacatggcgaaacaccatctctacaaaaaactaataaaagtaaaatttaaaa

SEQ ID NO: 9572 - DNA, 663 bp, Homo sapiens
aaaagccagtctacatctttacccatgcttttcttcctccctcttggaacaacagaagaaggtaactctcttccaccaactccctccctctatgagccagatccaccctacccagactgtctggaactttttactattcctattctctcccatatctgaatatctccaatctgttcaccttggcatgcttaagccttttacatctttaaaaacaacaaaacaaacctttccttgatccccacatcttcatcgcactctcttccttcacatcttcaccctctatttgctttttttttttttaagagacagggccttgctgtgttggccaggctggagcacagaggtacaatcatagctcactgcagcctcaaactcctgtgctcaagggatcctcctgcttcagcctcccaagcagctagaactataagcatgagccaccatacctagctaaatttaaaaaattttttgtagacacagggtctcactatgttgctcagattggtctaaaactcctgaggtcaagcaacctgtccactaagctttcttcggtcctctcacgcaacagcaccttagctctgctccaccattgggtagctggttttcagtaaggtcagcagtgatcaccaggtcaataaatctaacacaggccttctcagttcttcc

SEQ ID NO: 9573 - DNA, 389 bp, Homo sapiens
cactccatatgcagaacatcattgtgtggaccttgcaggcggattctgagtttggattgctggcatctgctctccctctccctgcactgattctcgggttcttgacctgagcagggtctcaccactgagacacagccctggagggtgggcttacatgaaaacatggccggatggggagtggacggcagaggagaccagaggacaatatccagagactcccagtttagctgcatgcagagacctgttgtttgtatatttttgctttctaaaagaaatgctagagatagctgggcccagtggcatgtacctatagtctcaactactcaggagttcaagtccagcctgggcaacatattgagaccccgtctctaaaaaaaaaaaaaaaaaag

SEQ ID NO: 9574 - DNA, 319 bp, Homo sapiens
ggaggcagaggttgtggtgagctgagatcatgccactgcactccagcctgggcaacagagtgagagactctgtgtcaaaaaaaaaaaaaaaagaaccgcagccacaataatgaggaatgaatgaaagagggaacatcactaaagaaataaaaaagataatatgggaatactatgaataactgggcaccagccagttagacaccctagactaaacaaattcccagaaagatacaaactaccagaaccaactcacaaagtatagaaaatatgaatagaactataacaagtgattatatcagtaactttaaacgtctcccaa

SEQ ID NO: 9575 - DNA, 469 bp, Homo sapiens
ttgctgtgttgacccccacctggatgtctgtcacatctatggagagagggtggagaagaaaggacggtgagcagggggttgaacttgttcttgacccctctgtggcctcagtttcctccccagatctgtaaaggggtctgtaggttagctgtttctgagaagctagacaaaccacttaagtctgaggattggtcactttagtggaaagagtgagatggaaacccacaaagtcaggacaccctggattctaatccttgtccaaccagtaaccaaatttattttgccttggagggcaaatgaaatccctgggccttagattcctcatctgtaatgcgatattcttagttatgcccatgttttttaaagtgtaggaaccttggcactaggatggcataacactgaatcacacattgagaactgtattcctttccgatcactttaaatccttctggttgttaaaaaaaaaaaa

SEQ ID NO: 9576 - DNA, 313 bp, Homo sapiens
gaaagaaacctcgacccacgtcacatctgcaatctaagagccccactgtggccatctccccagtttctcccatgcactagaaaagggctgagcaatcgctcatccttggtattgggtggcctctgttatggtcctctgaagtatgctgtgctcgcagagtttatctgccctgcactctttactcttgctgctttgatgtcttcttatggctggtatgtgttttgtagttattctggccaccagcagttttttctgcaaatcctgtgtcctgctgggtatgtctgttccttcctgttcccccaacaacacattc

SEQ ID NO: 9577 - DNA, 566 bp, Homo sapiens
ataattattctcaatcactgagctggattgacgaatgcttgcttttatctcttgaattttgggtatctcttaatttattaaaaatatgtgtgttttgatatttacttatcatctcatggtttaatatcacaaaaactgtttttttaaaaataacctttgttcattagcattagattcattaaaccaatctcaactgtgtgcttgaattatttctatgctcctaaaaaagtataataatgcaatgtaactgcctgatgggttctctctgtccactgcacaaataccatggcattgcagtaaaaaagagtttaactgatgcaaggctaatcatgtcaaatgggagatagagttattgctcaaataagtcacctagaggttttgagggtaggagtttttcaaagacagcttggtgggcagggagctagggtaatggcggttctgattgggtcaaagatggaatcatagggaagtcgaagctggcctctttggctgagtcacttctgggtgggaccacaggagtgattggcaggtgaaggtggagccatcagtgatcagacatgaaaaaa

SEQ ID NO: 9578 - DNA, 226 bp, Homo sapiens
tcattttctcttgctgccaccatgtaagaagtgcctttcacctcccgccatgattctgaggcctcccctgtcatgtggaactgtaagtctaattaaacctctttttcttcccagtcttgggtatgtcttcatcagcagcatgaaaacagactaacacaccttgaaaacaatgccaagcaatgaaattcacttactcaaaaagttagggagtacaaaaacaaaaaat

SEQ ID NO: 9579 - DNA, 439 bp, Homo sapiens
caagagtgtgggagaaaaaaaatacgactatataacactccaagataatgagttagttaaggactcacagattcatcatttaatcactgaaacgacaggcacgcaagaacaagatcaagcttaatacaataacgctagattatatcaacaaatggatgccaacgggttaagacgggaggcctacataaaatgggttcaattcagagtgtggactcacacaaagttgcgaaactcgctttattggttctacaaatccaagtaagtgactagacccaggcttgcaaagctatatgtcagacacactttgttgcaagatgcaaagatgtcatcctaccccttgaacaggaaatcaccccacatactagtttattcttgttatcagcacatctcgttatgctccattttaacttattaaggttcctcaagagatgctcaattt

SEQ ID NO: 9580 - DNA, 181 bp, Homo sapiens
cctcaggagacctctgtaaactgcatccatgccgtagaccccgcatccaagcagtgctgcatccaccagccttaggaaagtggatcagaaaggaaatgtctcagtgatcctagacactaactttgacaaggaaagaccacccatagtggaagtggttggaaggtgagccttcaaattcaag

SEQ ID NO: 9581 - DNA, 492 bp, Homo sapiens
tgggtgaatgtaacatgggattatgtggctcctctgaaactctgggaattaccttaattttagccactggaaggagacagggtcctgctgatcattatataaagtagtattcagattgatgcataggtctcgtctgttttggttaggatgactgcatcatggacatcattttcagctatactcattgttgaccctcttgtagacctgtgagaatagcaactaagccttgggatcactgacacacctaaaaccctgcctaactaactgaaacactgaggaccccatcacctcagatatgagattgtcttattgcatccaatgaagattagtagaactacaaaaatggtttctctgtatgtttattaacaggaccttaagcacacctgtgccacaaggccacattttccatgatgtggataaaacacatctttgtttaccatggatgctatttttgtatgaaataaaacatgagacattaaataaaaaaaaaaa

SEQ ID NO: 9582 - DNA, 442 bp, Homo sapiens
cacatgtgaaggaaaaaggaaagaaaaagggagggaagaatagaaagactgtagtaagaaatccatgatcggtgcgaaacatggagttttcacaacgagctaaagaaacactataggctgtctcctagagacacacatttctgccatctaatctgcagatttgtttacattaaaaaacaagactaaatttaagcttcaaagtaaaagctcaacatttagggagacatacgggctgtttgctttgaatgaggggcaggagccagccttctccgagttggcccagagaaaatttttgaaacacagaaatgtaataatagctggcacatgggatgtgtggaatgaaatcagcactttcaaaaagaaaagaatgaagagaataataataataagccaatgcattcagttcttttggttaatgtcaaattttactcaccaatcttaa

SEQ ID NO: 9583 - DNA, 808 bp, Homo sapiens
ggtgaggctgggatgagaatcggccgaggattatttccatgagtaactatttctaaatgattggaaatttttgaaaaagtggtatggtttatatacctaatctgcttatctgctataagtcatatgagaacaacagctaggatgattgtccaagcagctttagatgtgtttagggccaggcaaaaggtttgcttgttttttctttttgcttaagatctgggagattagcaaatttctcaagactatagactgaactgtaatttttaccaactcttgctcatgagcctcaaaatgaatatatccttgaataaagtataaatatttcaatagatacatctctctattatccattttcacaattataaaagcatcagcaaaattgtggatatgtgttccagtcactcatggatccatggaaatggaccgtgtttaaatgaatgcttcccttggatgggatgttcagcaatagcaaaaaaaaaaaaaaaaaagttatcaataactgagatttcctgtggccccacttctgcatctgtactaccgagatgcatttggctactgagtttgtagcagtcagaacagcattcttccgggttcattaacttaatttttctcaataaaatattcataccctggaaaataaacataactgactactaaagataatttgagataaataaaagacccaatttaaatagttattcaggatagaaaaatttcatgaaagaggggaaaaacatagagagactatctttgactatcatacttaaaaagcatctattactaaattgaatgtcaaacttttctttaa

SEQ ID NO: 9584 - DNA, 837 bp, Homo sapiens
cacaccttccttctcttaattttgctttcccacccaccaagaaatttgtaagtcaaaatttatttccatgagtaactatttctaaatgattggaaatttttgaaaaagtggtatggtttatatacctaatctgcttatctgctataagtcatatgagaacaacagctaggatgattgtccaagcagctttagatgtgtttagggccaggcaaaaggtttgcttgttttttctttttgcttaagatctgggagattagcaaatttctcaagactatagactgaactgtaatttttaccaactcttgctcatgagcctcaaaatgaatatatccttgaataaagtataaatatttcaatagatacatctctctattatccattttcacaattataaaagcatcagcaaaattgtggatatgtgttccagtcactcatggatccatggaaatggaccgtgtttaaatgaatgcttcccttggatgggatgttcagcaatagcaaaaaaaaaaaaaaaaaagttatcaataactgagatttcctgtggccccacttctgcatctgtactaccgagatgcatttggctactgagtttgtagcagtcagaacagcattcttccgggttcattaacttaatttttctcaataaaatattcataccctggaaaataaacataactgactactaaagataatttgagataaataaaagacccaatttaaatagttattcaggatagaaaaatttcatgaaagaggggaaaaacatagagagactatctttgactatcatacttaaaaagcatctattactaaattgaatgtcaaacttttctttaa

SEQ ID NO: 9585 - DNA, 458 bp, Homo sapiens
gaaaattccatcagctgaatgttgaaaaataactatttccttaggaggataatggtgttacctgaccgttgaaggagaaatataatagatgtgaccatatccaaaaaggtcactgaaaagatatcttaaggaaaaaaaaatggactaggtgcagtggctcacgcctgtaatcccagcattttgggaggctgagatgggtggatcacttgagcccaggggttggagaccagcctaggcaacatagcaaaatcccatctctataaaaaacgcaaacaatcagccaggaatagtggcagacaccagtagtcccagatacctggaaggctgaggtggaaggatcacctgagcccaggacattgaggttacagtgagccttgaccatgccactgcactgcagcctgggaaaagagcgagactttgtcttgaaacaaaaaggaaaaaaaagaagtattattaat

SEQ ID NO: 9586 - DNA, 401 bp, Homo sapiens
tttatcagtttctcatccaattctgaactttattaaaggacattaatcatagagaccatttactcttttgaggttgctgactagatgtctgtggaactatatgaatctactaagacaaacacacgtctataagagagtgaggcaaatagttggttatggctgctaatacgcttctgaaaggcaattttaaagaagataaaatgtgttttgtgcaatcaatgtcagtgaaatcagttgaattttccaaagcaattgctctaaaagacaacactcatctgttttgctggatatttgatttgtttttgtggtcgttgtttaaatccatttctactcttttaaagttataacttattggtatatggttcattcttcaccaatgcagatatattgagaagaatgga

SEQ ID NO: 9587 - DNA, 600 bp, Homo sapiens
tcccttctcagcctcttttttcatgctaacaggcataaatgaaatgataaaagtttgagctcttctcgtggaattctcgtgatacagatatgtgctacatgttcatcatctcgttggtcttcaccatgataactgtggagtaagaattataagcaggtcacagattagggacttgagattgacagtttggcttccctgttctgggtggcaaagcctgtggagtactcacctacctgctgcatgaaggcagcatggagggactgtggtggattatctgcaaagatggccaaaattctctcatccctgcaggcacatacaagatgccagaatcagtcaaaactaagctcactgtccttgctaatattctgccccagagaagaactgaagctcagctcttcaccctacagaaagcctgaattttgtaaatgttctgcttagaatgaggaagaaagatgaagaatgaggaggaagaagggaggaacgagagagaggtaaagccaacaagcagaacagacctacatttgcagcatctccaagtttctgcaacagcattatgttgttgttatgttttgttttaataaaagcacataccatttaaaa

SEQ ID NO: 9588 - DNA, 544 bp, Homo sapiens
tcccttctcagcctcttttttcatgctaacaggcataaatgaaatgataaaagtttgagctcttctcgtggaattctcgtgatacagatatgtgctacatgttcatcatctcgttggtcttcaccatgataactgtggagtaagaattataagcaggtcacagattagggacttgagattgacagtttggcttccctgttctgggtggcaaagcctgtggagtactcacctacctgctgcatgaaggcagcatggagggactgtggtggattatctgcaaagatggccaaaattctctcatccctgcaggcacatacaagaagaactgaagctcagctcttcaccctacagaaagcctgaattttgtaaatgttctgcttagaatgaggaagaaagatgaagaatgaggaggaagaagggaggaacgagagagaggtaaagccaacaagcagaacagacctacatttgcagcatctccaagtttctgcaacagcattatgttgttgttatgttttgttttaataaaagcacataccatttaaaa

SEQ ID NO: 9589 - DNA, 326 bp, Homo sapiens
caatccagttttcttacgtcaatactttggtttttgctttgtgaagatgccagaatcagtcaaaactaagctcactgtccttgctaatattctgccccagagaagaactgaagctcagctcttcaccctacagaaagcctgaattttgtaaatgttctgcttagaatgaggaagaaagatgaagaatgaggaggaagaagggaggaacgagagagaggtaaagccaacaagcagaacagacctacatttgcagcatctccaagtttctgcaacagcattatgttgttgttatgttttgttttaataaaagcacataccatttaaaa

SEQ ID NO: 9590 - DNA, 314 bp, Homo sapiens
tcccttctcagcctcttttttcatgctaacaggcataaatgaaatgataaaagtttgagctcttctcgtggaattctcgtgatacagatatgtgctacatgttcatcatctcgttggtcttcaccatgataactgtggagtaagaattataaaatgaggaagaaagatgaagaatgaggaggaagaagggaggaacgagagagaggtaaagccaacaagcagaacagacctacatttgcagcatctccaagtttctgcaacagcattatgttgttgttatgttttgttttaataaaagcacataccatttaaaa

SEQ ID NO: 9591 - DNA, 675 bp, Homo sapiens
tcccttctcagcctcttttttcatgctaacaggcataaatgaaatgataaaagtttgagctcttctcgtggaattctcgtgatacagatatgtgctacatgttcatcatctcgttggtcttcaccatgataactgtggagtaagaattataagcaggtcacagattagggacttgagattgacagtttggcttccctgttctgggtggcaaagcctgtggagtactcacctacctgctgcatgaaggcagcatggagggactgtggtggattatctgcaaagatggccaaaattctctcatccctgcaggcacatacaaggtaagaacacctttaccagtggaatgtgatgaaaatgctgcccagacaattctagacagggccttaagaggtctagatgcttccacatttgctttcttgggagctctgagttatcatgtgagaaccaccagtctccccaacctgcaccctaagctcattatccacaaggctgtgcaaaataataaatcactgttgttaggacgcaaagtttggtagtggtttgttatgtagtcgtggataactgcagcagggatctcagcaacttttcttctctgaactaatgtttaaagtcaggatgtaacatattgtctccatgtgactttgttgaactaaataaagaatgctaataccagat

SEQ ID NO: 9592 - DNA, 2016 bp, Homo sapiens
tggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggatttgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctgggtactctggttactgagataaataaggcactggacatcctcacgtggagttcacaggctcatcagtgaattctgtaccacatttcaaccttgtttattttagtttaatggaatatacattcttagtattgcctgattatttaaatttgttgagggggattgcatgttgctttattggcctgtaaaaatagctagtttggtaagatttggtctcgcaccttccatctttgctaccacattaaagatgagcttgttaaaaaggaaagcatatttctctgattgcccttatggagaaataaagataaaattcaaagaaacaaaaaaaaagt

SEQ ID NO: 9593 - DNA, 1161 bp, Homo sapiens
ccttgctatattaatttcattactgtgtttaattgcacccttgccaaaatatttagcatgtgaaaaggttttttttaaaaaatatgtaatgccttcatattgaagctggttactgtacgcaagttgagtgccagacctctagtacgccgtatgttacatgaaactactgccaaaatcttagtaagattgttgttgaaaagattgttgtcttaagcattaatattgaatttatatagaagttaaatgtagatgataatgacatcattgatcttcctgtgtccgtattttcctacaatttggtgccttgtatctgttgctgattcacttttaccactagtgtaaaaataagtgaaaaaatatttttactttacatttttatatatcagagtaacataaattataaatttgtgtctcaaaaccacctgtgatggaggatgtgctaattgtaatgtcataggtacaaagtattttggcatgatgaaaagctcaatagctattgtttttcaatagcagattttatctcggctaccttcaatcacaagtaaaattataaagataaaaaacatctacataaacatgttggctgccaaattttttgcattggaaatactggaatctctcattaaagttcttggaacattatagtgatgccatgttagattaccttggagcttcataactttagctttttcctaaaaatatatgtttatgctgataaaaactattacatttatgggatattttgtatccatatagagtttttcagaattgttcattaaaatgctttttataagcttatattatttgtagaatatggcaaaagcatttacagctcatcatgtatctatctgctcctgttcacttccaaacctcttgtagttaggcaatgccatttgactacttcaagcagagggattgtaaacagaagtgattttctatttccatgttggactgtaaaaagttctgcatgaccctccagttttcttttgcctgtcatggtgacctgaaagcaagatgttccaaatggcatacttacaagacggatgcaacctgggtccttaggtcgctgtttagaagggacctgactggagtgctgatggacttgcagtaaactttttaagtgtaagaaataaactgttatgtgttaaaccactgtgaatt

SEQ ID NO: 9594 - DNA, 430 bp, Homo sapiens
taggtactattatagccccattttataagatgagggaaaactgagggttttgaagaatttaaagtaagcttgcccccaaggtcaccccagctagtgaatgggcagagtgggatttgaattcaatatagtcatgatccccctactgccctacttgaaaggggcagggatggggtttgggagcagagagaaacaacaacaacaacaaaaaactccacccccaaattgctctttctgccaaagcatctcctgctattgactgccaacctgaacacttagtcacaggacagctctgggtatgtctcttggggctaaatgtctcctttagggctaactgcttctcctgtggggactgtgttaaagtttatcttctgcctcccctcccaggagtttccacacctgctgcagctttaaataggaatcttaattattt

SEQ ID NO: 9595 - DNA, 549 bp, Homo sapiens
attcttttatttagtagctgtttattgagcatctactcagtgcttgacacatagactaaatgagattctgtcaaggactggtgccatgtttttaagaacatggaatgctgtgagctaagagcttactttttttttttttttagaatttattcacacatttttagatattgtacccatgactctataattttgtcttcccacttctctaatatcaaaatttttttaaactgtcaattaaacaaaaagttttaggtcctactaaggcttctagcttttgcccttgaaaccaggcctaagtacagctatacgtgctccttgccacctccctaagttttcttgaaaaagctctaggtgcagatgaactgaaaaaaacaaaaaaagttggttaaagaggaaaaatcagcaaaacaaactactttgcataacacttatattttctacataatattaagatatgctataaatagcaaagattataattcttaagttctttttaaagaacaaaatacgctcataataatcagagcaaaaataaactaaaatatatgt

SEQ ID NO: 9596 - DNA, 528 bp, Homo sapiens
acttcttaactgctgtcgacaccaaagcacttccatagatgtcccaactatcccctagatgattgtgttgtcctcattaagaatgacctctagtcatacaggaaaacatttttctgttttatcattcactcttcttttttttttcttgcttattattcactactttagcacagccttttagtctaaaagacaaagatttacttggcctttagacaattcctatatgtctttaaatttcttatttcctcaccactcttattattgatgttttcttttccataagtgttaggacagtgccttggtacatagtagatactcaattagtatttgttgaatgaaggaaacttaactgtaggctttttcttcttgccactttctgctttttgtacctgttgaaaatgatggaggtaccagtgttcataaaaaccttgaaaacaggctgggtgcagtggctcatgcctgtaatcccagcactttgggaaggcgaggcaggcagatcactcgaggtcaggagttcaagaccaacct

SEQ ID NO: 9597 - DNA, 2977 bp, Homo sapiens
gggtagctggagatttccatcatggcggcgtccatttcgggctacaccttcagtgctgtgtgtttccacagcgccaacagcaacgcggaccacgaaggatttttactgggagaggtaagacaagaggaaacgtttagcatcagtgactcacaaatcagcaacacagaatttctgcaagtaattgaaatccataaccatcagccttgttcaaaactttttagtttttatgactacgcaagcaaagtgaatgaggagagtttggacaggattcttaaagatcggagaaagaaagtcattgggtggtacagattccggcgcaatacgcagcagcagatgtcctacagagagcaggttcttcacaagcagctcacccgcatcctcggcgtgcccgacctcgtctttcttctcttcagcttcatctccactgccaacaattccactcacgctttagaatatgtgctcttcagaccaaatagaaggtataatcagaggatatcactcgctattcccaatctaggaaatactagccagcaagagtacaaagtgtcttcagtgccaaatacttctcagagttatgccaaagtgattaaagaacatggtactgacttttttgacaaggatggagtgatgaaagacatcagggcgatttatcaggtttataatgcacttcaggagaaagttcaggcagtgtgtgcagatgttgaaaagagtgagcgagttgttgaatcttgtcaggcagaagtgaacaaattaagaagacaaatcactcagaggaaaaatgaaaaggaacaagaaagaagattgcagcaggcagtgttaagcagacagatgccgtctgaaagcttggacccagcgttcagtcctcggatgccgtcctctgggtttgcagctgaaggcagaagtacacttggagatgcagaggcctcggatcctcctcccccttactctgattttcacccaaacaatcaagaaagtactttgagccactctcgcatggaaaggagtgtctttatgcctcgacctcaagctgtgggctcttccaattatgcttccaccagtgccggactgaagtatcctggaagtggggctgaccttcctcctccccaaagagcagctggagacagtggtgaggattcagacgacagtgattatgaaaatttgattgaccctacagagccttctaatagtgaatactcacattcaaaggattctcgacccatggcacatcccgacgaggaccccaggaacactcagacctcccagatttaactaaacaaaagaaactctccacctagcactgtttttcttcattgcttactgagagggtttttgagaacttaatctggggggagaactgctttctcagataccttaactcccgagaagagagtccttgtgcacagaacttgtgggagcctccatccgctgctctttacctttggatacagtgtgcaagtttcatgacagaatcattaagataatcaaattgtcctaattctggtgcgattcatggatatactggtaaatttaggcaaagtgaaacttatcagcgtagtttctgttctttaaaataaattggaaattagagactaagcacaattagtctataaatgttctataaatcaaaaacttacctcttgcactatcatgccttgaaatttactttttcaaagggaaacaagtttagcagcagccttcaaagaacttctttctatgatgagccaaattcatctttgccagaaaagaaattttgataattccaagaagcctgattagaacaaatcagatataccttctcttgtctgcatgactttgtgagataaaagagagggcttccaacttttttctactagcttgatatgtattatcacttaaaatggttgcctttaaaaaaaaaaagtagagatactaattaccagtaagtaatcatccaaataaatacgtcataaaataaattaattattttttctttgatggattacagtgactactgtgttgcactggcacatttatggtctctgttctggaatcttggaggacacacagcagtggagaacagaaggagtgagttttataatgaacagattccagacacggtaggtttagctgagttcatacagaggagatataactcatttagatcttctgacaaatcctagtgttagttttatctgtggaggaaagacatttaataataaactgtttgggaatcttggtgaataaagattcattttcaagctgaataaccatacttattttattttaagttgccatttggggaataattgcagtatgtgtagagactctcttgggatgcacttatatttttatttaatgactacttgttttctagttttgcccacaacgtctgaaaccactaagacattcaggagcatgttgagcttctggtttggaaacagcaagacccaccatttatgacaaggacagccatgaggttaatacttggagtttaactgccttccctttgaactagttaaaatctgtaagaataaggaagttgttgaaggcttaaaatctgggttctgaaaaagtagtttcagtttataggatacacatttactcactgagctccagttccaatactaaattagacagtatcatatagacggaaaatgaaatgctagaactgccgttctttggatcgccactctatgggggtctgtcttttaactactctcctggttatgttggccttacaccactgccatttgatttaaaacgctgcagacactttatctgcaaatgtgttccagttgttatcagctacctactacgcagcttcagcgccagtgtgaatttatttttttttaagtgccattaccgtctcctctgttcagattttgacattcaggaaaatatttttattttgatgccatactgaaatctacaatgtatatctgacaaagcagttaaatgtgacaataaaaaacttatttaatcatggtaaaaaaaaaaa

SEQ ID NO: 9598 - DNA, 460 bp, Homo sapiens
tagatctccctactgtatcctagtgttagttttatctgtggaggaaagacatttaataataaactgtttgggaatcttggtgaataaagattcattttccagctgaataaccatacttattttattttaagttgccatttggggaataattgcagtatgtgtagagactctcttgggatgcacttatatttttatttaatgactacttgttttctagttttgcccacaacgtctgaaaccactaagacattcaggagcatgttgagcttctggtttggaaacagcaagacccaccatttatgacaaggacagccatgaggttaatacttggagtttaactgccttccctttgaactagttaaaatctgtaagaataaggaagttgttgaaggcttaaaatctggcttctgccaaagtagttcccgtttataggataccctactcactgagctccagttcc

SEQ ID NO: 9599 - DNA, 3224 bp, Homo sapiens
gggtagctggagatttccatcatggcggcgtccatttcgggctacaccttcagtgctgtgtgtttccacagcgccaacagcaacgcggaccacgaaggatttttactgggagaggtaagacaagaggaaacgtttagcatcagtgactcacaaatcagcaacacagaatttctgcaagtaattgttctaggagtagcagggagaaggcagcaacagaagtgtccttagttaatgaggtgatgcagtaacaagtattggaaagaatgaaagcaggaaggagaagaaatgttcaacgcacccaacagaaagagaagcaagaacaacagtaccacacagcagggatttgtaaagaaatgtgtgccgagaggcgatgtgtacatgagcaggtgtctactgtgttgttgaggcacaagaaactctggaaattccagaaatccataaccatcagccttgttcaaaactttttagtttttatgactacgcaagcaaagtgaatgaggagagtttggacaggattcttaaagatcggagaaagaaagtcattgggtggtacagattccggcgcaatacgcagcagcagatgtcctacagagagcaggttcttcacaagcagctcacccgcatcctcggcgtgcccgacctcgtctttcttctcttcagcttcatctccactgccaacaattccactcacgctttagaatatgtgctcttcagaccaaatagaaggtataatcagaggatatcactcgctattcccaatctaggaaatactagccagcaagagtacaaagtgtcttcagtgccaaatacttctcagagttatgccaaagtgattaaagaacatggtactgacttttttgacaaggatggagtgatgaaagacatcagggcgatttatcaggtttataatgcacttcaggagaaagttcaggcagtgtgtgcagatgttgaaaagagtgagcgagttgttgaatcttgtcaggcagaagtgaacaaattaagaagacaaatcactcagaggaaaaatgaaaaggaacaagaaagaagattgcagcaggcagtgttaagcagacagatgccgtctgaaagcttggacccagcgttcagtcctcggatgccgtcctctgggtttgcagctgaaggcagaagtacacttggagatgcagaggcctcggatcctcctcccccttactctgattttcacccaaacaatcaagaaagtactttgagccactctcgcatggaaaggagtgtctttatgcctcgacctcaagctgtgggctcttccaattatgcttccaccagtgccggactgaagtatcctggaagtggggctgaccttcctcctccccaaagagcagctggagacagtggtgaggattcagacgacagtgattatgaaaatttgattgaccctacagagccttctaatagtgaatactcacattcaaaggattctcgacccatggcacatcccgacgaggaccccaggaacactcagacctcccagatttaactaaacaaaagaaactctccacctagcactgtttttcttcattgcttactgagagggtttttgagaacttaatctggggggagaactgctttctcagataccttaactcccgagaagagagtccttgtgcacagaacttgtgggagcctccatccgctgctctttacctttggatacagtgtgcaagtttcatgacagaatcattaagataatcaaattgtcctaattctggtgcgattcatggatatactggtaaatttaggcaaagtgaaacttatcagcgtagtttctgttctttaaaataaattggaaattagagactaagcacaattagtctataaatgttctataaatcaaaaacttacctcttgcactatcatgccttgaaatttactttttcaaagggaaacaagtttagcagcagccttcaaagaacttctttctatgatgagccaaattcatctttgccagaaaagaaattttgataattccaagaagcctgattagaacaaatcagatataccttctcttgtctgcatgactttgtgagataaaagagagggcttccaacttttttctactagcttgatatgtattatcacttaaaatggttgcctttaaaaaaaaaaagtagagatactaattaccagtaagtaatcatccaaataaatacgtcataaaataaattaattattttttctttgatggattacagtgactactgtgttgcactggcacatttatggtctctgttctggaatcttggaggacacacagcagtggagaacagaaggagtgagttttataatgaacagattccagacacggtaggtttagctgagttcatacagaggagatataactcatttagatcttctgacaaatcctagtgttagttttatctgtggaggaaagacatttaataataaactgtttgggaatcttggtgaataaagattcattttcaagctgaataaccatacttattttattttaagttgccatttggggaataattgcagtatgtgtagagactctcttgggatgcacttatatttttatttaatgactacttgttttctagttttgcccacaacgtctgaaaccactaagacattcaggagcatgttgagcttctggtttggaaacagcaagacccaccatttatgacaaggacagccatgaggttaatacttggagtttaactgccttccctttgaactagttaaaatctgtaagaataaggaagttgttgaaggcttaaaatctgggttctgaaaaagtagtttcagtttataggatacacatttactcactgagctccagttccaatactaaattagacagtatcatatagacggaaaatgaaatgctagaactgccgttctttggatcgccactctatgggggtctgtcttttaactactctcctggttatgttggccttacaccactgccatttgatttaaaacgctgcagacactttatctgcaaatgtgttccagttgttatcagctacctactacgcagcttcagcgccagtgtgaatttatttttttttaagtgccattaccgtctcctctgttcagattttgacattcaggaaaatatttttattttgatgccatactgaaatctacaatgtatatctgacaaagcagttaaatgtgacaataaaaaacttatttaatcatggtaaaaaaaaaaa

SEQ ID NO: 9600 - DNA, 2241 bp, Homo sapiens
gggtagctggagatttccatcatggcggcgtccatttcgggctacaccttcagtgctgtgtgtttccacagcgccaacagcaacgcggaccacgaaggatttttactgggagaggtaagacaagaggaaacgtttagcatcagtgactcacaaatcagcaacacagaatttctgcaagtaattgaaatccataaccatcagccttgttcaaaactttttagtttttatgactacgcaagcaaagtgaatgaggagagtttggacaggattcttaaagatcggagaaagaaagtcattgggtggtacagattccggcgcaatacgcagcagcagatgtcctacagagagcaggttcttcacaagcagctcacccgcatcctcggcgtgcccgacctcgtctttcttctcttcagcttcatctccactgccaacaattccactcacgctttagaatatgtgctcttcagaccaaatagaaggtataatcagaggatatcactcgctattcccaatctaggaaatactagccagcaagagtacaaagtgtcttcagtgccaaatacttctcagagttatgccaaagtgattaaagaacatggtactgacttttttgacaaggatggagtgatgaaagacatcagggcgatttatcaggtttataatgcacttcaggagaaagttcaggcagtgtgtgcagatgttgaaaagagtgagcgagttgttgaatcttgtcaggcagaagtgaacaaattaagaagacaaatcactcagaggaaaaatgaaaaggaacaagaaagaagattgcagcaggcagtgttaagcagacagatgccgtctgaaagcttggacccagcgttcagtcctcggatgccgtcctctgggtttgcagctgaaggcagaagtacacttggagatgcagaggcctcggatcctcctcccccttactctgattttcacccaaacaatcaagaaagtactttgagccactctcgcatggaaaggagtgtctttatgcctcgacctcaagctgtgggctcttccaattatgcttccaccagtgccggactgaagtatcctggaagtggggctgaccttcctcctccccaaagagcagctggagacagtggtgaggattcagacgacagtgattatgaaaatttgattgaccctacagagccttctaatagtgaatactcacattcaaaggattctcgacccatggcacatcccgacgaggaccccaggaacactcagacctcccagatttaactaaacaaaagaaactctccacctagcactgtttttcttcattgcttactgagagggtttttgagaacttaatctggggggagaactgctttctcagataccttaactcccgagaagagagtccttgtgcacagaacttgtgggagcctccatccgctgctctttacctttggatacagtgtgcaagtttcatgacagaatcattaagataatcaaattgtcctaattctggtgcgattcatggatatactggtaaatttaggcaaagtgaaacttatcagcgtagtttctgttctttaaaataaattggaaattagagactaagcacaattagtctataaatgttctataaatcaaaaacttacctcttgcactatcatgccttgaaatttactttttcaaagggaaacaagtttagcagcagccttcaaagaacttctttctatgatgagccaaattcatctttgccagaaaagaaattttgataattccaagaagcctgattagaacaaatcagatataccttctcttgtctgcatgactttgtgagataaaagagagggcttccaacttttttctactagcttgatatgtattatcacttaaaatggttgcctttaaaaaaaaaaagtagagatactaattaccagtaagtaatcatccaaataaatacgtcataaaataaattaattattttttctttgatggattacagtgactactgtgttgcactggcacatttatggtctctgttctggaatcttggaggacacacagcagtggagaacagaaggagtgagttttataatgaacagattccagacacggtaggtttagctgagttcatacagaggagatataactcatttagatcttctgacaaatcctagtgttagttttatctgtggaggaaagacatttaataataaactgtttgggaatcttggtgaataaagattcattttcaagctg

SEQ ID NO: 9601 - DNA, 225 bp, Homo sapiens
tgggaggctgaagtacgagaatcgcttgaatgtgggaggcggaggttgcagtgagtcgagatcgtgccactgcactccagcctgggcgacaaagcgagactccatctcaacaacaacaaaaaagaatatcacattttgaacatgaaatgtctgcatcttgttttgaatatgtatgaattgaaaaagctgtgctaactcacttgaagcagagctgtctacccttag

SEQ ID NO: 9602 - DNA, 349 bp, Homo sapiens
caagaaagtactttgagccactctcgcatggaaaggagtgtctttatgcctcgacctcaagctgtgggctcttccaattatgcttccaccagtgccggactgaagtatcctggaagtggggctgaccttcctcctccccaaagagcagctggagacagtggtgaggattcagacgacagtgattatgaaaatttgattgaccaaatcagatataccttctcttgtctgcatgactttgtgagataaaagagagggcttccaacttttttctactagcttgatatgtattatcacttaaaatggttgcctttaaaaaaaaaaagtagagatactaattaccagtaagtaa

SEQ ID NO: 9603 - DNA, 2778 bp, Homo sapiens
tagacgctcgggcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgcgatgtggccaggttctgcgagccccaaagggtcagattttgttggaaagctatcccctaaatgctcactgtgaatggaccattcatgctaaacctgggtttgtcatccaactaagatttgtcatgttgagcctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatcttctggaggctgggaagtccaagatcaaggcgtcagaagattcattgtctgtccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccgcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactacaaaaaaaaag

SEQ ID NO: 9604 - DNA, 2727 bp, Homo sapiens
tagacgctcgggcaccagccgcggcaaggatggagctgggttgctggacgcagttggggctcacttttcttcagctccttctcatctcgtccttgccaagagagtacacagtcattaatgaagcctgccctggagcagagtggaatatcatgtgtcgggagtgctgtgaatatgatcagattgagtgcgtctgccccggaaagagggaagtcgtgggttataccatcccttgctgcaggaatgaggagaatgagtgtgactcctgcctgatccacccaggttgtaccatctttgaaaactgcaagagctgccgaaatggctcatgggggggtaccttggatgacttctatgtgaaggggttctactgtgcagagtgccgagcaggctggtacggaggagactgcatgcgatgtggccaggttctgcgagccccaaagggtcagattttgttggaaagctatcccctaaatgctcactgtgaatggaccattcatgctaaacctgggtttgtcatccaactaagatttgtcatgttgagcctggagtttgactacatgtgccagtatgactatgttgaggttcgtgatggagacaaccgcgatggccagatcatcaagcgtgtctgtggcaacgagcggccagctcctatccagagcataggatcctcactccacgtcctcttccactccgatggctccaagaattttgacggtttccatgccatttatgaggagatcacagcatgctcctcatccccttgtttccatgacggcacgtgcgtccttgacaaggctggatcttacaagtgtgcctgcttggcaggctatactgggcagcgctgtgaaaatctccttgaagaaagaaactgctcagaccctgggggcccagtcaatgggtaccagaaaataacagggggccctgggcttatcaacggacgccatgctaaaattggcaccgtggtgtctttcttttgtaacaactcctatgttcttagtggcaatgagaaaagaacttgccagcagaatggagagtggtcagggaaacagcccatctgcataaaagcctgccgagaaccaaagatttcagacctggtgagaaggagagttcttccgatgcaggttcagtcaagggagacaccattacaccagctatactcagcggccttcagcaagcagaaactgcagagtgcccctaccaagaagccagcccttccctttggagatctgcccatgggataccaacatctgcatacccagctccagtatgagtgcatctcacccttctaccgccgcctgggcagcagcaggaggacatgtctgaggactgggaagtggagtgggcgggcaccatcctgcatccctatctgcgggaaaattgagaacatcactgctccaaagacccaagggttgcgctggccgtggcaggcagccatctacaggaggaccagcggggtgcatgacggcagcctacacaagggagcgtggttcctagtctgcagcggtgccctggtgaatgagcgcactgtggtggtggctgcccactgtgttactgacctggggaaggtcaccatgatcaagacagcagacctgaaagttgttttggggaaattctaccgggatgatgaccgggatgagaagaccatccagagcctacagatttctgctatcattctgcatcccaactatgaccccatcctgcttgatgctgacatcgccatcctgaagctcctagacaaggcccgtatcagcacccgagtccagcccatctgcctcgctgccagtcgggatctcagcacttccttccaggagtcccacatcactgtggctggctggaatgtcctggcagacgtgaggagccctggcttcaagaacgacacactgcgctctggggtggtcagtgtggtggactcgctgctgtgtgaggagcagcatgaggaccatggcatcccagtgagtgtcactgataacatgttctgtgccagctgggaacccactgccccttctgatatctgcactgcagagacaggaggcatcgcggctgtgtccttcccgggacgagcatctcctgagccacgctggcatctgatgggactggtcagctggagctatgataaaacatgcagccacaggctctccactgccttcaccaaggtgctgccttttaaagactggattgaaagaaatatgaaatgaaccatgctcatgcactccttgagaagtgtttctgtatatccgtctgtacgtgtgtcattgcgtgaagcagtgtgggcctgaagtgtgatttggcctgtgaacttggctgtgccagggcttctgacttcagggacaaaactcagtgaagggtgagtagacctccattgctggtaggctgatgccgcgtccactactaggacagccaattggaagatgccagggcttgcaagaagtaagtttcttcaaagaagaccatatacaaaacctctccactccactgacctggtggtcttccccaactttcagttatacgaatgccatcagcttgaccagggaagatctgggcttcatgaggccccttttgaggctctcaagttctagagagctgcctgtgggacagcccagggcagcagagctgggatgtggtgcatgcctttgtgtacatggccacagtacagtctggtccttttccttccccatctcttgtacacattttaataaaataagggttggcttctgaactacaaaaaaaaag

SEQ ID NO: 9605 - DNA, 432 bp, Homo sapiens
gctttatatttctcttctccagcttcaggaggatgctccaccattgatgaaggaagggtcaagagtgaagaagggatgctccatgtggcaatgtgacaccaattttccacgacggggaggaaaaagtccagtagttgacaatgaataggatgccacaacctcttgagtgaaaggtaacctgtatggtggactctcaatctctgtatactcataagagatccacaggggaacataaagagagaagtaaaatgtgttcagaagtttaagattctccaaggtttaagctggtcagttgatcagtcaaaggatgaagattcagttttacaagacaagaattaagaagttttacttacatatacgaagttgcattggattacgtttcattaccataaaaatagtcataagactatcaagtagtttaatgataatgta

SEQ ID NO: 9606 - DNA, 392 bp, Homo sapiens
tggcctttacaatccatggaaagacagacatttacttcttatgatgtgattaatgtataattacaaactgtgactgaaaggtgtgtggtgctgcaggtgggctataactaagaaatgggctgggcatggtggctcacgcctgtaaccccagcacttggtgaggccgaggtgagtggattgcttgaggccaggagtttgagaccagcctgaccaacacagtaaaaccccgtcactaataaaaatgcaaaaattagctgggcatgatggtgagtgcctctagtcccagctactcagggggctgaggcaggaggatcacttgaacctgagagatcgaggctgcagtgagtggagattgcaccactgtactccagcctgggtgacagagtgagtga

SEQ ID NO: 9607 - DNA, 310 bp, Homo sapiens
aatatttcagtcacttagttgtttatttcaataaagaaaatatgtaaaaaatgaatgccaatatgaaaatacctctttatttatttactttttgcttccagattgctgatttcagattcaattaccaaagtagaattactcaagtaaacacaaaagaattctagtacagaatgtgttccacaaaaatatgttcagtaaaagacaactccatagattccctacttggagattgagaaaataaattaacatcataaaagtgctgagaacgtgcaatatagaaattctattgttttaaaagccatatatcctt

SEQ ID NO: 9608 - DNA, 334 bp, Homo sapiens
acatgcattgcaacattagtaactaaaagaagctacaagttaaacaaattggctttgccttcacatgctttatcacataattctcctaagtgttagaaaacatcacttttagacaaattatccaggttaacaaaccaatgtatgtattaatcagaaaataacaaaagaaattggtttcattctctagcttatataaccaaaagattaacatttcaaatcctgtattagttcaaccccaggaaaaggtgaaagtcaaacattaatctaagttaaaaaattttgctagaataagtttgatatcagaaccaaaacaatggcaatgtttgttttgtct

SEQ ID NO: 9609 - DNA, 479 bp, Homo sapiens
ctctctaatacatgatctgtttttctcatgtacatttcattctagcatcataaatattattaggtacatctctaaaagattcatatttcttggttgcggttatcttagcagtttgtacttcaaggaaactggaagggtctgttgaacaaaattgtgcaatttttacttaggttagtgcccactgcccatcttcttcaagttcaggtgcggtggctcacgcctgtaatcccagcactttgggaggctgagacaggtggatcatgaggtcaggagttcaagatcagcctggccaacatagtgaaaccctgtctctactgaaaatacaaaactcagctgggtgtggtggtgggcacctgtggtcccagctactcaggaggctgaggcaggagaattgctttaacccaagagatagaggtcgcagtgagccaagatcgtgccactgcattccaccctgggtgacagagcaagactctgccttc

SEQ ID NO: 9610 - DNA, 392 bp, Homo sapiens
taggcttcccataggcaaggatgactttcagaatgttctagaaaaaaggatacttcagggggcccataactgcttgattcaaatctttcctttaaaaacataaaaacaacagttggacttctaaaacacacactgaagacatacgcgctgccacgtaagctctccacatgttcactttgccttcagggaaactgtgtgcacatcaacgtgccctgggaaaggctgcagggctgcactgcgggcagttcagatcctagagcacttgctctggcctgggagcgctgcaggcaactgaagccacacagaccctgctcctgcaagaacttttgtgtgtgtcccatggtgatgtcattagtttgcttattaattatatttatataaacttctaaacc

SEQ ID NO: 9611 - DNA, 1529 bp, Homo sapiens
tttttttagagatgggatcttgctacgttggccaggctggtctcgaactcctggcctgaagtgatccttctgccttggcctcccaaaatgctgagattgtaggcatgagccgccatgcctagcccagcttgtctttttgtttacttaccagtgtttttcagagaacaaaaattttaatttgatgaagtccaattaattaaatttttaaaatagagtgtgatttttttgtcatgtctaagaaactattgtctagtcctaggtcctaattctcctttgttttcttctaaatgttttattattttacatgttaacgtttagatttatgatctattttaagttttttttaagtatgaggtttatgttttttgtttgtgtttaggagcatatggatggatgtctagttgttccagcaccatttgttggaaagactatcctttctctgctgaatttcttttatatctttgtcaggaattagccatattggtatgggtctatttctagactttttattttctcccattgatctgtacatctctccttttgccaataccacataagtcaagatgactatagctttgtaataagtattaaaatctggtaatataattcttccaattttatttttcttttaaaattattttgactattgtatcagtgttacctttccatttaaattttaggattagcttagctacaaaagtcctgctgggattttgattagaattgcattaaatctatagataagtttggggagaattaacatatttatgatcgccttttaatccgtgaacatgacgtgtctctccatttatttgcatgtttagtttctttcttcagcattttatagttttagcatacagatcttgtacatattttcttagatttgtaactattttcttggagctgttgtaaatggtattgtttttctgatttttggtttctacttgttcattgctggtgtatagaaatacagttggcttttgtgtcggctttgtatcccgtgatgcaagtaaagcagtactgaggggaatttatagggctcaatgcctgtgttagaaaaaaaggtctcaaatcagtgacctcagcttccactttaagaaactaggaaaaaaagaccaaattaaaagtgtacacagaaaaggggaaatcatgcaagtaaaacagaaattagacattaggaagagaaaatatagaaaattaattaaccaaaagctggttctttgagaagctcaagaaaattctctttagactgatcaggagaaaagatagattaccaatgtcagaaattaggtagcttcactacagattctacagatattacaacaataataagagactattacgaataacttctaggaatacatttgacaatttagatgaacccatgcagattccttaaaagatacaaattagtttacttaggaagaagtggaaaacctacatagctctatgaaagatgtgttatcacaaagaaaacggtagacataggtagctttagtggtaaatgttgccacgtatttaagggaata

SEQ ID NO: 9612 - DNA, 1130 bp, Homo sapiens
agagagagagagagagagagagagagagagagagagagctctgctgaatttcttttatatctttgtcaggaattagccatattggtatgggtctatttctagactttttattttctcccattgatctgtacatctctccttttgccaataccacataagtcaagatgactatagctttgtaataagtattaaaatctggtaatataattcttccaattttatttttcttttaaaattattttgactattgtatcagtgttacctttccatttaaattttaggattagcttagctacaaaagtcctgctgggattttgattagaattgcattaaatctatagataagtttggggagaattaacatatttatgatcgccttttaatccgtgaacatgacgtgtctctccatttatttgcatgtttagtttctttcttcagcattttatagttttagcatacagatcttgtacatattttcttagatttgtaactattttcttggagctgttgtaaatggtattgtttttctgatttttggtttctacttgttcattgctggtgtatagaaatacagttggcttttgtgtcggctttgtatcccgtgatgcaagtaaagcagtactgaggggaatttatagggctcaatgcctgtgttagaaaaaaaggtctcaaatcagtgacctcagcttccactttaagaaactaggaaaaaaagaccaaattaaaagtgtacacagaaaaggggaaatcatgcaagtaaaacagaaattagacattaggaagagaaaatatagaaaattaattaaccaaaagctggttctttgagaagctcaagaaaattctctttagactgatcaggagaaaagatagattaccaatgtcagaaattaggtagcttcactacagattctacagatattacaacaataataagagactattacgaataacttctaggaatacatttgacaatttagatgaacccatgcagattccttaaaagatacaaattagtttacttaggaagaagtggaaaacctacatagctctatgaaagatgtgttatcacaaagaaaacggtagacataggtagctttagtggtaaatgttgccacgtatttaagggaata

SEQ ID NO: 9613 - DNA, 479 bp, Homo sapiens
gctctttcgctctgacttcctagaaccaaaatgaaaagaaaaccctaactttccatgtctaagtaacaaagaaccagaggctactacctctgaccttttctgtgaggcagatgggaaattggctgtctgcaacaagtaagactgattgctggtcaagtcttcatttgcaaagaagtataactttgtaacttcatcctagcctctgattggttgctttttgcaactcatcagattgtttgcacaggagtgtgacttttgtaacttcacttcagcctctggttggctgctttctgcaaccaatcagactgattgcggctaccatttcagttacatgaggtgagcatgaagtggccgatgggaaaattctggtgggtatttggaccaggaagattctgtatccaggcccctgagctgctgctcaggcccactcccacactgtggagtgtacttttgttttcaataaattcctgctttggttc

SEQ ID NO: 9614 - DNA, 366 bp, Homo sapiens
gactcaaataccttctgcttttaaataagcattgtttttcttggatgaaaaattcatagtagtgatcaagaagaatatattcacttatgtgtgtagaaggtagttaaagagcacctactatgttctacgctctgtgctggctccatgaaaaggacagatacagacatttcctttggagctgagagtagagtgagagttttttaaaataattacccaatggaattatacattctccatagactatattcaggttaacgtttgatcacattaaaaaatcttttttgaaaaccttttatcatttcatctttccctatggaaattgaaaaaaaacattttatcacctcctctttccccacagaaattcaa

SEQ ID NO: 9615 - DNA, 445 bp, Homo sapiens
atccttttatactcaatcaaacaaaagctcaaagtttttgttttgataagaaaataaaaattttgtgggctcttacatagtgggtactttgattatgtgtgataatactgtgctgtgacaaataatataatgaagaaattaataccaagattgctattctgaaagattaaacattctttaatacttagatctttcatctgtttatgtaacaaaccctaacatacaggcttaaggccttgcagatattaacttctttaacttaatctttgtaacagtcccatgaagtaggtactattatgattacgtttcccatttgaggactacaagtcataaagatattaacgaccttgcccaacagctagttagtggcggagcctacttttgaactcagacactctggctctagactcttttcgtttattaaccactgcactatgttacattg

SEQ ID NO: 9616 - DNA, 468 bp, Homo sapiens
caaaaattagctgggtgtggtggcacatgcctataatcccaggtacttgggaggctgaggcaggagaatcatttgaacccaggaggcagaggttgcagtgagccaaggttgcaccactgtactccagcctgggtgatatagcaagactatgtctcaaaaaaaaaaaaaaaaaaaaaaaaaaaagaagaagaagaagaaaaaaaaagaagaagagaaaaagaagaagaaaactctttgctttgaattggggggcatagctgggtgcagtggcccacacctatagttccagctatgcaagaggctgaggctggaggatcacttgagcccaggagttccagtccagtgtgggcaacatggcaagacccttatatcttaaaaaaaaatccctcaaggctgggtgcggtggctcacacctgtaatcctagcattttgggaggccaaggcaggcagatcccttgaggtcaggag

SEQ ID NO: 9617 - DNA, 301 bp, Homo sapiens
aagcacaccagatctcatgtgttgaaatgtgaacatgctcaccacagaccaaggacattcaacctgtcaatccccaggatttccaagccaggagtttcatctcttacttgtggaaaatttgtccatttaattgtgaaccaatcagcttttcattgtgtcaaaatcaaatctagatagtgaaatatatattttatctttattgttatcttaaatatatcttggcttaaagagacataagtagctcttccccactacaccagataatgagttgcaaataaatcattcagtagtaaagttcaaa

SEQ ID NO: 9618 - DNA, 364 bp, Homo sapiens
  misc_feature (319)..(320): n is a, c, g, or t
agtgagcattacatgagatctgatggttttgtaagtgtttggtaattcctcctgcgttcattctcccctctgctgccttgtgaaaaagatgccttgctttccctttgccttctgccatcattgtaagtttcctgaggcctccccagccatgcagaactgtgagtcaattaaacctctttcctttctagattacccagtctcaggcagttctttataggcagtgtgagaatggactaatactgtggtcttgggataacatctgggaggaattctctgggattaccagggtaggagactcttgttttcttcccttactttnntccaaaatgagtggcagtctctctctctctctggggctaaggtt

SEQ ID NO: 9619 - DNA, 344 bp, Homo sapiens
ttttttttttcttattatccttttagttttcccaagtattttcagcaagacttaatgattgagattttcaccacaactaggcaagttcaagttgtatactctttaatctacaggcactcttcacaagttcatctacgatggtgtgctggaagttaaagagctgagctactgtggagatattgagatgaatatatttaagctgggcatggtagcatgtgcctgtagtcctagctactcaggaggctgaggtgggaggatcacttgagcccagtagtttgaagttgcactgagctatgatcatgccactgcattccagtttgggtgaaagagtaagaccccacctc

SEQ ID NO: 9620 - DNA, 410 bp, Homo sapiens
agagcccgtcaaagatgttatgtttccttttttctgacctcggggactcgagaggtgagtgcttagttctcccagaggtacagagattacgaaggcttatggagacaagtaagttgccagacatcacacagccagtgtcctggtgtcttaacctcagcttgtaggtgccatcctgctgagacatccagcttagagctgccatcctcagctctaagcatcagacatgcatctcgtttctcctgaaggatttcctccatccttgatgtgtgcttgtggggagggaggattttccacatgaaacttggctttcctagtaagcattgtcccccgtccccagtttaactaaaactgcaatttgtgttctaatcaattcagattagaagaaagcaataaagaattaaaaaacaata

SEQ ID NO: 9621 - DNA, 498 bp, Homo sapiens
ggcgcgtagtagagggaagcgactgaggagcggggactgggcagcatttgaatggatgcgggtgccgctggcacccgggaagacgcctgggagccggcgctggggagccgggcatgggctgggatgtgtttggattccaatctgggcctgacaccagttcagtgacctcgggaagttccccaaccctgcgggcctgtttcctccctctgaagtggcgacagtaatagaaccgacctcgtaggctcatcgggaggtcctgatgggagaacccatgcaacttgccaccacagagccaggcccgcggcgactggctcctggtgggtattaaagacgagtcgggaaagaagagcaggctcaatcaaaccttcaatggccccgaaagacatcttgattgaaacctcatgagagactctgagccagaaaacccagcaacttagaacccagatacctgaccatcagccactgtgtgaaataataaatgtttgttgttaaaaaaag

SEQ ID NO: 9622 - DNA, 543 bp, Homo sapiens
ggcgcgtagtagagggaagcgactgaggagcggggactgggcagcatttgaatggatgcgggtgccgctggcacccgggaagacgcctgggagccggcgctggggagccgggcatgggctgggatgtgtttggattccaatctgggcctgacaccagttcagtgacctcgggaagttccccaaccctgcgggcctgtttcctccctctgaagtggcgacagtaatagaaccgacctcgtaggctcatcgggaggtcctgatgggagaacccatgcaacttgccaccacagagccaggcccgcggcgactggctcctggtgggtattaaagacgagtcgggaaagaagagcagggttgcctgctgaggaagcttttcacagcatgagaccttccgcaggctcaatcaaaccttcaatggccccgaaagacatcttgattgaaacctcatgagagactctgagccagaaaacccagcaacttagaacccagatacctgaccatcagccactgtgtgaaataataaatgtttgttgttaaaaaaag

SEQ ID NO: 9623 - DNA, 1952 bp, Homo sapiens
  misc_feature (6)..(6): n is a, c, g, or t
gccctnctctgcctggtggcgccgggaggctgtttttccactcactggcgcgcagactccatcccactgttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggttgccagcgtcgctacagcccagaccaaggcagaataatctccggatgagctggtggcaccgctgagcctttggtctcaccagggcttcctgttgctggcaggcggggtggagcggagctgctgggaggctgctggataggagaggggtcacggctgcggaagaggaggttcttcgggacacccgtggatggacacggcaaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9624 - DNA, 1849 bp, Homo sapiens
  misc_feature (6)..(6): n is a, c, g, or t
gccctnctctgcctggtggcgccgggaggctgtttttccactcactggcgcgcagactccatcccactgttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggcggggtggagcggagctgctgggaggctgctggataggagaggggtcacggctgcggaagaggaggttcttcgggacacccgtggatggacacggcaaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9625 - DNA, 2085 bp, Homo sapiens
  misc_feature (6)..(6): n is a, c, g, or t
gccctnctctgcctggtggcgccgggaggctgtttttccactcactggcgcgcagactccatcccactgttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggcggggtggagcggagctgctgggaggctgctggataggagaggggtcacggctgcggaagaggaggttcttcgggacacccgtggatggacacggcaaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaaggaaaaaaaaaaaaaacaaaaaaaacaaaacaaaaaggggggccccccctaaaaaatttcccatacagagagggcgccccacgaggaactaagcagcggagacccacagcaggacacagggacacaaaaagagggggccaccaaaaataacgggacggcagcggaatcaagaacaccacaggggacacacacgggccggacggggagaaacacagcggggagcacggggagaacaacgg

SEQ ID NO: 9626 - DNA, 2244 bp, Homo sapiens
cacaatcaggcatcttttattcttttctttccctccaacatccctaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9627 - DNA, 2653 bp, Homo sapiens
  misc_feature (6)..(6): n is a, c, g, or t
gccctnctctgcctggtggcgccgggaggctgtttttccactcactggcgcgcagactccatcccactgttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggttgccagcgtcgctacagcccagaccaaggcagaataatctccggatgagctggtggcaccgctgagcctttggtctcaccagggcttcctgttgctggcaggcggggtggagcggagctgctgggaggctgctggataggagaggggtcacggctgcggaagaggaggttcttcgggacacccgtggatggacacggcaaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9628 - DNA, 2706 bp, Homo sapiens
atggccacatggctctgcctgagcccatctggcagccttccttggcagggacagaaggggtgatctagaaggggtgatccctccatgaagcatggaagggaacagggctaggtctgtgtttggcgctcaccccatccctccactccctggcttcctctggcctggggagttttgtttttcaccctccagagggggaggacatggggccacaccctggcctgtctctcaggcttgtgtgggtggaggctgggaagggagttgggctaaacttcgctgttgcccgaggccatggccacttcccggcaggttgccagcgtcgctacagcccagaccaaggcagaataatctccggatgagctggtggcaccgctgagcctttggtctcaccagggcttcctgttgctggcaggcggggtggagcggagctgctgggaggctgctggataggagaggggtcacggctgcggaagaggaggttcttcgggacacccgtggatggacacggcaaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9629 - DNA, 2450 bp, Homo sapiens
  misc_feature (6)..(6): n is a, c, g, or t
gccctnctctgcctggtggcgccgggaggctgtttttccactcactggcgcgcagactccatcccactgttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9630 - DNA, 2073 bp, Homo sapiens
cacaatcaggcatcttttattcttttctttccctccaacatccctaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9631 - DNA, 1749 bp, Homo sapiens
  misc_feature (6)..(6): n is a, c, g, or t
gccctnctctgcctggtggcgccgggaggctgtttttccactcactggcgcgcagactccatcccactgttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9632 - DNA, 1853 bp, Homo sapiens
  misc_feature (11)..(11): n is a, c, g, or t
  misc_feature (14)..(14): n is a, c, g, or t
  misc_feature (28)..(28): n is a, c, g, or t
ctctgtttgcnggntacacggccaaccnggtgcgagtctggcaggtgaccattggcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9633 - DNA, 2005 bp, Homo sapiens
atggccacatggctctgcctgagcccatctggcagccttccttggcagggacagaaggggtgatctagaaggggtgatccctccatgaagcatggaagggaacagggctaggtctgtgtttggcgctcaccccatccctccactccctggcttcctctggcctggggagttttgtttttcaccctccagagggggaggacatggggccacaccctggcctgtctctcaggcttgtgtgggtggaggctgggaagggagttgggctaaacttcgctgttgcccgaggccatggccacttcccggcaggttgccagcgtcgctacagcccagaccaaggcagaataatctccggatgagctggtggcaccgctgagcctttggtctcaccagggcttcctgttgctggcaggcggggtggagcggagctgctgggaggctgctggataggagaggggtcacggctgcggaagaggaggttcttcgggacacccgtggatggacacggcaaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9634 - DNA, 1978 bp, Homo sapiens
cacaatcaggcatcttttattcttttctttccctccaacatccctaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctcccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9635 - DNA, 912 bp, Homo sapiens
atggaatcacagccacaagggcctgcttctcttacccaagcagaacttgctcctttttccattcgctctggggggtagggcttaggcagttccttcgcccctcctgaactgtgcccattctctggccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9636 - DNA, 2060 bp, Homo sapiens
cacaatcaggcatcttttattcttttctttccctccaacatccctaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggcctccagtgcagcctctggccttattttatatatttaaatttttgataaagtttttcttactaaaagga

SEQ ID NO: 9637 - DNA, 2063 bp, Homo sapiens
cacaatcaggcatcttttattcttttctttccctccaacatccctaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccaatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9638 - DNA, 1882 bp, Homo sapiens
cacaatcaggcatcttttattcttttctttccctccaacatccctaggaaagagcaaggctcaggatgatttatcctcttttcactgatgaggaatctgaggcccagagaacagtcatgaagtgtgatcagaccctgaggtctccaaaaagataatgtccttgcgaactccagggattctggcatcttgctgtacccaccccagcccacacggcaggatcctatccaagtcccttatccacccggacactcactttagcttttacaccctcaaggctgagaccctaaggacacgccctggatccaaggagtccctggcccctctgctaatatgcgccacctggactcccagagggaaagccggtcagcaccccacatgcattagcaccatgggccacccccaagccctaccccaggagaagctcgtggtggcaaaaagaacctaagcatttgaggcaggtcacccaagcttgaatctcagtctgcctctcatctgtgaccctggcgagccactcgtcctcaggaagccttcactttccctagtgcacggcgggcacacagctcaacgtgggactgtgaggatgggaaatgaggggtgccatgcaccctggaggaactcagtgaacagtggcaactgtcacttccctggggccctatggtccttcctttctccccagcctgtccacactagcatcttcctcaactcctggttttcagagggaaacacttatcggtcatctgctccacaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattaatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 9639 - DNA, 343 bp, Homo sapiens
tatcaagaattctagctttagttatctgctctgtgaggaaaacacctgagtccattccagttacacctctggcttctgttcagatccccatctttctggtggacaggggctggtaggggctcttacctccctgtgtttgtccatttgggctgctaaaacaagacaccttaaaccaggtggctcataaacaacagaaatgtctgtctcacaatgctggaggctgtgaagtccagatccggtgtctaatgagtgcccattttctggttaatagaggatgccttcttgctgtgtcctcacatggtgaaggggtagaattctggtcttttcagccccttataagggc

SEQ ID NO: 9640 - DNA, 361 bp, Homo sapiens
cttttaagtctagctcagatgctacctcctatatgaaaccttttctgggctcttcagttggaagcaatctctttctttcctatatttccagaacaattttctttgtacagcccttataacatccccgtatattgccatgtgctgtcatcatttacatgtgactatcttaatgggactaccgtaagagaaattacctgaaacacacctactattcagtccaatgttcagtcagtggggatggtattatttctgtatgttttgctgtttaaatcaaaggttctctgggaggtggaggtttcaatgagccaagatcacgccactgcactccagcctgggtgacaaagcgagactccatctcaaa

SEQ ID NO: 9641 - DNA, 1612 bp, Homo sapiens
cttagacgctccccagatgattctaatgagcagcctggttgagaactacttcacgtggtagcgcctcctgcccagaaccgtgggatatagccctgggcaaaccctcaccaggatcaggcctgtcttccctatgaggtgtaacctatgctccaggctctgtaatgttcccccaggcaagagcttcctcctccagatttaagggtgcccaggctgggagactgtcccctgtctttcccaggtggtcctgtgcttcttgggctcatcacaggaaagacctgtcccaggtgcaaggtctctctgatgtagaaggcctcccctgagatggacagtctgggggatcttcccacgtgaacctgtctcttgctccgcaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccaggtgagtggcctgcctgctgccctgctgcagcccgactcagctcagcacccgtggcctggcacatggagccagtgcaaggaggggcaaggaccttctccaggtgcccattgccctcggggtcacggcccttgtggacctcactggcctcagctgttgttactgcaccccgtccccactgtttctcatctctaggtctttgcacatgctgtgtcctttaccagagagacacccctctcccgcttttccctgtttctctggccatccccttgtcctctctcagtctagcttcctccaggaagccctccctgattgctctagctgggtgagggacccgacctctgtgtccccacagggctctgtgcatgtccatcatagcagtggtaggctgtcacgcccgtgtctctttatctgcccacctcactcaatctactgggagttcttgaaggcaagagctcagtctcctccatttccatatccccagtttgtggcacaaaataagcaattattaaatattttggaataaatataactggtttttacagagcatatgattcatccatttaacaaatacttatagaaacttttactctatgccagacactattctagatgttgaggatacagcaaggaagaaaacagacgaaaatctctgccttcgtggggcatacagtctagttgagtgtgtgaaagggagactcaaagctataaatgctttaagaaaaatttgtggctgggtgcggtggctcacacctgtaatcccagcactttaggaggctgaggcgggtggatcacctgaggtcaggagttcatgaccagcctggccaacgtggcgaaaccccatctctactaaaaatacaaaaattagctgggtgtggtggtgggcgtctgtaatcccagctacttgggaggcttaggcaggagactcgcttgaacccaggagatggaggctgcagtgggccgagattgcgccattgcactccagcctggatgacaagagtgaaactctgtctcaagag

SEQ ID NO: 9642 - DNA, 246 bp, Homo sapiens
tccgctcacccctgcccccacccacctgtcttcgcaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaacccagttcgtccctttccagttttacagtgaattgctgcgggtgcgttgggccaccacggtgcgttggcccaa

SEQ ID NO: 9643 - DNA, 3518 bp, Homo sapiens
gagagccggagcccgagcccggagcctggccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccacctctcggcccacgccatcaagcacgccaaggcctactgctgcagcatgtgtgggcgggcctacacctcggagacctacctgatgaagcacatgtccaaacacacggtggtggagcacctggtgagccatcactcgccccagaggacggagtcccccggcatcccggtgcgaatctctctcatctgagcccactggaggcgccgccccacccggcccactggcagacacagacccaggcagcaccaggccccagctccctccgggggccctccaggaaccaccaagctctctcacgaccttcccaatcttccagaaagcttggtccgcagaagccctgcctggtccagtccgggggcggccaggccaactgcaagattctggactgttttggtggcatccaaagacgatctcagagcactttgaacctctctgttgagttttcttttgttccccacccttcacttgcttcactgtttttttttttttccgttttttttttttaagttggttttggaaataacagaaaagatatttattggccaggaagttggtgctgctaagaccgagaaatttaaagaatcggacagatggacgcagagaaccagagggcaatgtgggaccttctcttgccatggcctcaggtcttgagggaaggctcgggcctaggtttctggactgcaaaggggacccccaggtgggaggggcaggaagcagccggagtgagcccttcgcccctgagtgcctggctcgcacctctcgagctgtgccctgggcatcactgagcagaggggtgcggcagcttcaggaggcggaaacgagaggggtgggagatccacaggaccaaagggtgcagtgatgggctgggtggcgggcccagggaaatggggtggggatgggctgggtaagacctggccctcccctgctgccctgaagaccaccccagtctacctcggtgctggccaggaaacctttcggctacctctcccaccatcccagactgtgggcagggggatggggagggagtgggcctggatctgggacctccctccagaatttcctccagatgggggcagtgcccagggaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccggaaaaaaaaaaagaaaaaaaaaaacaaaaaaaaaaaaaaaaaaaaaaaataaaaaaaaaaagaggggcgggccggcgcccaacaaaatattccccccggaggggcccccacggttcttccgcgcctgcccccccagtttcttcggtgcccaaagaggcggcccccaaagggagagcgacgcctgttatcatgatcacgacggcagcgcgcccgcccgttttaaacaaaccagccggtcggcagggcgggcgacaaacctcccttgctctggcggcaactccttggcgaaaagagaccacctcatcccctccgggggggggcgacgacaccatcagggggccacacctccccccagcagcattttaaccccctccgggggacaata

SEQ ID NO: 9644 - DNA, 3392 bp, Homo sapiens
gagagccggagcccgagcccggagcctggccggagccccagcccggccctgctcgggccgccgggcgcggggctgcggccgcgtcccggaggcgccgccagcacagccaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccacctctcggcccacgccatcaagcacgccaaggcctactgctgcagcatgtgtgggcgggcctacacctcggagacctacctgatgaagcacatgtccaaacacacggtggtggagcacctggtgagccatcactcgccccagaggacggagtcccccggcatcccggtgcgaatctctctcatctgagcccactggaggcgccgccccacccggcccactggcagacacagacccaggcagcaccaggccccagctccctccgggggccctccaggaaccaccaagctctctcacgaccttcccaatcttccagaaagcttggtccgcagaagccctgcctggtccagtccgggggcggccaggccaactgcaagattctggactgttttggtggcatccaaagacgatctcagagcactttgaacctctctgttgagttttcttttgttccccacccttcacttgcttcactgtttttttttttttccgttttttttttttaagttggttttggaaataacagaaaagatatttattggccaggaagttggtgctgctaagaccgagaaatttaaagaatcggacagatggacgcagagaaccagagggcaatgtgggaccttctcttgccatggcctcaggtcttgagggaaggctcgggcctaggtttctggactgcaaaggggacccccaggtgggaggggcaggaagcagccggagtgagcccttcgcccctgagtgcctggctcgcacctctcgagctgtgccctgggcatcactgagcagaggggtgcggcagcttcaggaggcggaaacgagaggggtgggagatccacaggaccaaagggtgcagtgatgggctgggtggcgggcccagggaaatggggtggggatgggctgggtaagacctggccctcccctgctgccctgaagaccaccccagtctacctcggtgctggccaggaaacctttcggctacctctcccaccatcccagactgtgggcagggggatggggagggagtgggcctggatctgggacctccctccagaatttcctccagatgggggcagtgcccagggaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccggaaaaaaaaaaagaaaaaaaaaaacaaaaaaaaaaaaaaaaaaaaaaaataaaaaaaaaaagaggggcgggccggcgcccaacaaaatattccccccggaggggcccccacggttcttccgcgcctgcccccccagtttcttcggtgcccaaagaggcggcccccaaagggagagcgacgcctgttatcatgatcacgacggcagcgcgcccgcccgttttaaacaaaccagccggtcggcagggcgggcgacaaacctcccttgctctggcggcaactccttggcgaaaagagaccacctcatcccctccgggggggggcgacgacaccatcagggggccacacctccccccagcagcattttaaccccctccgggggacaata

SEQ ID NO: 9645 - DNA, 3280 bp, Homo sapiens
gagagccggagcccgagcccggagcctggccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccaggagacctacctgatgaagcacatgtccaaacacacggtggtggagcacctggtgagccatcactcgccccagaggacggagtcccccggcatcccggtgcgaatctctctcatctgagcccactggaggcgccgccccacccggcccactggcagacacagacccaggcagcaccaggccccagctccctccgggggccctccaggaaccaccaagctctctcacgaccttcccaatcttccagaaagcttggtccgcagaagccctgcctggtccagtccgggggcggccaggccaactgcaagattctggactgttttggtggcatccaaagacgatctcagagcactttgaacctctctgttgagttttcttttgttccccacccttcacttgcttcactgtttttttttttttccgttttttttttttaagttggttttggaaataacagaaaagatatttattggccaggaagttggtgctgctaagaccgagaaatttaaagaatcggacagatggacgcagagaaccagagggcaatgtgggaccttctcttgccatggcctcaggtcttgagggaaggctcgggcctaggtttctggactgcaaaggggacccccaggtgggaggggcaggaagcagccggagtgagcccttcgcccctgagtgcctggctcgcacctctcgagctgtgccctgggcatcactgagcagaggggtgcggcagcttcaggaggcggaaacgagaggggtgggagatccacaggaccaaagggtgcagtgatgggctgggtggcgggcccagggaaatggggtggggatgggctgggtaagacctggccctcccctgctgccctgaagaccaccccagtctacctcggtgctggccaggaaacctttcggctacctctcccaccatcccagactgtgggcagggggatggggagggagtgggcctggatctgggacctccctccagaatttcctccagatgggggcagtgcccagggaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccggaaaaaaaaaaagaaaaaaaaaaacaaaaaaaaaaaaaaaaaaaaaaaataaaaaaaaaaagaggggcgggccggcgcccaacaaaatattccccccggaggggcccccacggttcttccgcgcctgcccccccagtttcttcggtgcccaaagaggcggcccccaaagggagagcgacgcctgttatcatgatcacgacggcagcgcgcccgcccgttttaaacaaaccagccggtcggcagggcgggcgacaaacctcccttgctctggcggcaactccttggcgaaaagagaccacctcatcccctccgggggggggcgacgacaccatcagggggccacacctccccccagcagcattttaaccccctccgggggacaata

SEQ ID NO: 9646 - DNA, 2689 bp, Homo sapiens
gagagccggagcccgagcccggagcctggccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtgcctggctcgcacctctcgagctgtgccctgggcatcactgagcagaggggtgcggcagcttcaggaggcggaaacgagaggggtgggagatccacaggaccaaagggtgcagtgatgggctgggtggcgggcccagggaaatggggtggggatgggctgggtaagacctggccctcccctgctgccctgaagaccaccccagtctacctcggtgctggccaggaaacctttcggctacctctcccaccatcccagactgtgggcagggggatggggagggagtgggcctggatctgggacctccctccagaatttcctccagatgggggcagtgcccagggaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccggaaaaaaaaaaagaaaaaaaaaaacaaaaaaaaaaaaaaaaaaaaaaaataaaaaaaaaaagaggggcgggccggcgcccaacaaaatattccccccggaggggcccccacggttcttccgcgcctgcccccccagtttcttcggtgcccaaagaggcggcccccaaagggagagcgacgcctgttatcatgatcacgacggcagcgcgcccgcccgttttaaacaaaccagccggtcggcagggcgggcgacaaacctcccttgctctggcggcaactccttggcgaaaagagaccacctcatcccctccgggggggggcgacgacaccatcagggggccacacctccccccagcagcattttaaccccctccgggggacaata

SEQ ID NO: 9647 - DNA, 1491 bp, Homo sapiens
gagagccggagcccgagcccggagcctggccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctagggtagcaggaagacaaaccttctggaagactgagatagccctggatctgggacctccctccagaatttcctccagatgggggcagtgcccagggaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccggaaaaaaaaaaagaaaaaaaaaaacaaaaaaaaaaaaaaaaaaaaaaaataaaaaaaaaaagaggggcgggccggcgcccaacaaaatattccccccggaggggcccccacggttcttccgcgcctgcccccccagtttcttcggtgcccaaagaggcggcccccaaagggagagcgacgcctgttatcatgatcacgacggcagcgcgcccgcccgttttaaacaaaccagccggtcggcagggcgggcgacaaacctcccttgctctggcggcaactccttggcgaaaagagaccacctcatcccctccgggggggggcgacgacaccatcagggggccacacctccccccagcagcattttaaccccctccgggggacaata

SEQ ID NO: 9648 - DNA, 1370 bp, Homo sapiens
ggtcagactctcagaggatccccctcgggctcttacccttgtccttccaaggatttcccaggatatccagcgaagacatagcgtccaaagcggttcccctgagattccccgcggtttccccggtgcaatgcgagagaaaggtgcaccggggagtagctggcaaaccaggcccccgggctccgcgtggtccaacgcgtcctcgagcttcaaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccggaaaaaaaaaaagaaaaaaaaaaacaaaaaaaaaaaaaaaaaaaaaaaataaaaaaaaaaagaggggcgggccggcgcccaacaaaatattccccccggaggggcccccacggttcttccgcgcctgcccccccagtttcttcggtgcccaaagaggcggcccccaaagggagagcgacgcctgttatcatgatcacgacggcagcgcgcccgcccgttttaaacaaaccagccggtcggcagggcgggcgacaaacctcccttgctctggcggcaactccttggcgaaaagagaccacctcatcccctccgggggggggcgacgacaccatcagggggccacacctccccccagcagcattttaaccccctccgggggacaata

SEQ ID NO: 9649 - DNA, 1094 bp, Homo sapiens
actctctaatttccaccgctacagaatccacacagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccggaaaaaaaaaaagaaaaaaaaaaacaaaaaaaaaaaaaaaaaaaaaaaataaaaaaaaaaagaggggcgggccggcgcccaacaaaatattccccccggaggggcccccacggttcttccgcgcctgcccccccagtttcttcggtgcccaaagaggcggcccccaaagggagagcgacgcctgttatcatgatcacgacggcagcgcgcccgcccgttttaaacaaaccagccggtcggcagggcgggcgacaaacctcccttgctctggcggcaactccttggcgaaaagagaccacctcatcccctccgggggggggcgacgacaccatcagggggccacacctccccccagcagcattttaaccccctccgggggacaata

SEQ ID NO: 9650 - DNA, 2254 bp, Homo sapiens
gagagccggagcccgagcccggagcctggccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccacctctcggcccacgccatcaagcacgccaaggcctactgctgcagcatgtgtgggcgggcctacacctcggagacctacctgatgaagcacatgtccaaacacacggtggtggagcacctggtgagccatcactcgccccagaggacggagtcccccggcatcccggtgcgaatctctctcatctgagcccactggaggcgccgccccacccggcccactggcagacacagacccaggcagcaccaggccccagctccctccgggggccctccaggaaccaccaagctctctcacgaccttcccaatcttccagaaagcttggtccgcagaagccctgcctggtccagtccgggggcggccaggccaactgcaagattctggactgttttggtggcatccaaagacgatctcagagcactttgaacctctctgttgagttttcttttgttccccacccttcacttgcttcactgtttttttttttttccgttttttttttttaagttggttttggaaataacagaaaagatatttattggccaggaagttggtgctgctaagaccgagaaatttaaagaatcggacagatggacgcagagaaccagagggcaatgtgggaccttctcttgccatggcctcaggtcttgagggaaggctcgggcctaggtttctggactgcaaaggggacccccaggtgggaggggcaggaagcagccggagtgagcccttcgcccctgagtgcctggctcgcacctctcgagctgtgccctgggcatcactgagcagaggggtgcggcagcttcaggaggcggaaacgagaggggtgggagatccacaggaccaaagggtgcagtgatgggctgggtggcgggcccagggaaatggttttgtttattttttatttttatatttttttttatttttttattgattattttttctttttttttattatttttttattttattatttttttgt

SEQ ID NO: 9651 - DNA, 1481 bp, Homo sapiens
  misc_feature (1314)..(1314): n is a, c, g, or t
  misc_feature (1377)..(1377): n is a, c, g, or t
  misc_feature (1390)..(1390): n is a, c, g, or t
  misc_feature (1407)..(1407): n is a, c, g, or t
  misc_feature (1425)..(1425): n is a, c, g, or t
gagagccggagcccgagcccggagcctggccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccgctatccgtcgacggatagcggatctgcacgtggaatacanggctggttgcatgcaacggcaaagggcatgctcttctgcctgggggagggcctcttgtccctnccagcaggtcccngggacagggctggcagncaccccagtcccaaatangatgacaacaagaggaaacaaaccaaaatggaggagagccatccggctggaggagg

SEQ ID NO: 9652 - DNA, 1415 bp, Homo sapiens
  misc_feature (1341)..(1341): n is a, c, g, or t
  misc_feature (1350)..(1350): n is a, c, g, or t
gagagccggagcccgagcccggagcctggccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccgctatccgtcgacggatagcggatctgcagagctgctgaaccagtagcaaccaggtccggagaaaggnctctcttgnggaagaatgagagccaagccggggaagggttcatcctgcaaagctggggcagaaggtcttccttg

SEQ ID NO: 9653 - DNA, 1793 bp, Homo sapiens
gagagccggagcccgagcccggagcctggccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccacctctcggcccacgccatcaagcacgccaaggcctactgctgcagcatgtgtgggcgggcctacacctcggagacctacctgatgaagcacatgtccaaacacacggtggtggagcacctggtgagccatcactcgccccagaggacggagtcccccggcatcccggtgcgaatctctctcatctgagcccacttgacctttttcaccaagtcagagatgcagatccactccaagtcgcacacagaggcaaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctgcctgcgagaaggctttcactcagctctccaacctccagacccggcatctatcgcaataccatatttaacacgttca

SEQ ID NO: 9654 - DNA, 2122 bp, Homo sapiens
gagagccggagcccgagcccggagcctggccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccaggtgagtggcctgcctgctgccctgctgcagcccgactcagctcagcacccgtggcctggcacatggagccagtgcaaggaggggcaaggaccttctccaggtgcccattgccctcggggtcacggcccttgtggacctcactggcctcagctgttgttactgcaccccgtccccactgtttctcatctctaggtctttgcacatgctgtgtcctttaccagagagacacccctctcccgcttttccctgtttctctggccatccccttgtcctctctcagtctagcttcctccaggaagccctccctgattgctctagctgggtgagggacccgacctctgtgtccccacagggctctgtgcatgtccatcatagcagtggtaggctgtcacgcccgtgtctctttatctgcccacctcactcaatctactgggagttcttgaaggcaagagctcagtctcctccatttccatatccccagtttgtggcacaaaataagcaattattaaatattttggaataaatataactggtttttacagagcatatgattcatccatttaacaaatacttatagaaacttttactctatgccagacactattctagatgttgaggatacagcaaggaagaaaacagacgaaaatctctgccttcgtggggcatacagtctagttgagtgtgtgaaagggagactcaaagctataaatgctttaagaaaaatttgtggctgggtgcggtggctcacacctgtaatcccagcactttaggaggctgaggcgggtggatcacctgaggtcaggagttcatgaccagcctggccaacgtggcgaaaccccatctctactaaaaatacaaaaattagctgggtgtggtggtgggcgtctgtaatcccagctacttgggaggcttaggcaggagactcgcttgaacccaggagatggaggctgcagtgggccgagattgcgccattgcactccagcctggatgacaagagtgaaactctgtctcaagag

SEQ ID NO: 9655 - DNA, 1273 bp, Homo sapiens
gagagccggagcccgagcccggagcctggccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgggggtcttggcgggatggggtccgagtgggcttggggctggggcttgagccagggctgctccaggagcccagcagcggggctgaaacaggacccttagggctgaggggcagggctagggtccagaggggcggggccttctggagagccccacccacatcccaagtcccagttcggggagggctgctggggaggggaatagaggcttggacccttaggtgtggtctgtggctggcagccacccccacagcctggggttgtgagagtcggtttcctcctccctttaagcagtgttctcaaccctggccaccttagaatcacctgaagaggccgtgcacaatggctcatccctgtaatcccagcgctttgggaggccaaggcgggtggatca

SEQ ID NO: 9656 - DNA, 261 bp, Homo sapiens
tagctggcactttactattattattattgttattattgttattgttattcccatatacaaggtgctgttgggaacacagaggaagtgactggctgggggttcagggaaagctccgtagaagagggaacacttgagctgggtcttgaaggatgagtagaagttcaccaagtgggaaaggacactctaggtaaggagcctgtgattccaggttgcactctgtcaatgagggtttgttctttgggggattaaagcattgtgttc

SEQ ID NO: 9657 - DNA, 292 bp, Homo sapiens
taaatttggcatgtaggtaagagctgaatggctttcttcctcttaattttctaaacttcaaagtgcaagggaatctaattacagggtagagaagtactgtttcatcttctgactaattggaggctaaatctagaagtaatgtctgctgctacatccatatgacgctgtagaacatactttacaccttaatgatatgtgcacatttgttgcctctccagtaagcttgcttaggctcttcctttctccaggttctcttttactccaaagggagatgtagtaggacagaatatct

SEQ ID NO: 9658 - DNA, 4643 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaaggcacacattcaggggagttcatatatggcttggagaactttgtttacaaggacatcaagcctggacgtaaacgtaaaaagcacaaaaaacattttaagaaaccttttaaaggtcttgatcgttcaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaagaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggtaactagtttcatttctaggattctttaatat

SEQ ID NO: 9659 - DNA, 4597 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaaggcacacattcaggggagttcatatatggcttggagaactttgtttacaaggacatcaagcctggacgtaaacgtaaaaagcacaaaaaacattttaagaaaccttttaaaggtcttgatcgttcaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaagaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggtaactagtttcatttctaggattctttaatat

SEQ ID NO: 9660 - DNA, 491 bp, Homo sapiens
agtgcaagggaatctaattacagggtagagaagtactgtttcatcttctgactaattggaggctaaatctagaagtaatgtctgctgctacatccatatgacgctgtagaacatactttacaccttaatgatatgtgcacatttgttgcctctccagtaagcttgcttaggctcttcctttctccaggttctcttttactccaaagggagatgtagtaggacagaatatcttaggagttccacagttcaaagctacagctgtttagaattgaggtgaaactttgaagtttacaatatggaaagaaccatgtgtaacttggttatgttaaaaaaattttcttatagaaaactgtcaatgcagtggttgaattctttcaatcaaataagggattggatcttgagcaaataacatcagcaacattgatgaagctggaagaaattaaggagagaacagctacaggtgaagaatttgagtgtctacataagcatca

SEQ ID NO: 9661 - DNA, 4514 bp, Homo sapiens
tgcagcgctggtcgcagccctcagctgcgccgggcggttccggctcctccctctccttgtgcctcagcgccaccatggtgctggagtcggtggtcgcggacttgctgaaccgcttcctgggggactatgtggagaacctgaacaagtcccagctgaagctgggcatctggggcggaaatgtggctttagataatctacagataaaagaaaatgccctgagtgaattggatgttccttttaaagtcaaggctggccaaattgataaattaactttgaagattccttggaagaacctttatggagaagcagttgttgcgaccctggaaggattatacctgcttgttgtccctggagcaagtattaagtatgatgctgtaaaagaagaaaaatccttgcaggatgttaaacagaaagagctatcccgaattgaagaagcccttcaaaaagcagcagaaaaagataagccaaaagaagccaaaaaggatacatttgtggaaaaattggcaactcaagtaataaaaaatgtacaagtaaaaatcacagatattcacattaaatatgaagatgatgtcactgatccaaagcggcctctttcatttggtgtcacactgggagagcttagtctactgactgcaaatgaacactggactccatgcatattaaatgaagcagacaaaattatatacaagcttatacgacttgatagtcttagcgcctactggaatgtaaattgcagcatgtcttaccagagatcaagggaacagattttggatcagctgaaaaatgaaattcttacaagtggaaatatacccccaaattatcaatacattttccagccaatatcagcctctgcaaaactctacatgaatccttatgcagaatcagagctcaaaacgcccaaactggattgcaacatagaaatacaaaatattgccattgaactgaccaaacctcagtacttaagtatgattgaccttttggagtcagtggattatatggttaggaatgcgccttataggaaatacaagccttatttaccacttcataccaatggtcgacgatggtggaaatatgcaattgattctgttcttgaagttcatataagaaggtatacacagatgtggtcatggagtaacataaaaaagcacaggcagttactcaagagttataaaattgcctacaaaaacaagttaacacagtctaaagtctcagaagaaatacagaaagaaattcaggacttggagaagactctagatgtttttaacataattttagcaaggcaacaagcacaagttgaggtgattcggtctgggcaaaaattaaggaaaaagtctgctgacacaggcgagaaacgtggaggctggtttagtgggttgtggggtaagaaagagtctaagaaaaaggacgaagaatcattgattcctgaaactattgatgaccttatgactccagaggaaaaagataaactcttcactgccattggttatagtgagagtacccacaacctaactttacctaagcagtatgttgcccatattatgaccctgaagttagtaagcacctctgttacgataagagaaaacaagaatattccagaaatactaaaaattcagataattggcctgggcactcaagtatctcagcgaccaggagcacaagcacttaaggtagaagcgaaattagaacactggtatataacaggtttgagacagcaggatattgtgccatcacttgtggcttcaattggtgacactacatcatccttgcttaaaattaaatttgaaaccaatccggaggatagtcctgctgaccagactctgattgttcagtcccagcctgtggaggtcatctatgatgctaaaactgtcaatgcagtggttgaattctttcaatcaaataagggattggatcttgagcaaataacatcagcaacattgatgaagctggaagaaattaaggagagaacagctacaggacttacacatattattgaaactcgaaaagtccttgatttaaggataaatctgaagccttcttatctagtagttccacagacgggtttccaccatgaaaagtcagatcttctgattttagattttggtacatttcagctcaacagtaaagatcaaggtttacagaagactactaattcatctctggaagaaataatggataaggcatatgacaagtttgatgttgaaataaaaaatgtacaactactttttgcaagagcagaggaaacctggaaaaagtgtcgatttcagcatccatcaactatgcatatattgcaacccatggatattcatgttgagttggctaaggccatggtagaaaaagacattagaatggccagatttaaagtgtcaggaggacttcctttgatgcatgtgagaatttctgaccagaagatgaaagatgtgctatatttgatgaacagtatacctttgccacagaaatcatcagcccagtctccagagagacaggtatcctcaattcctattatttcaggtggtacaaaaggtctacttggtacttcactattgctagacactgtggaatcagagtctgatgatgagtattttgatgctgaagatggagaaccacagacttgtaaaagtatgaaaggatcagaacttaaaaaagctgcagaggtcccaaatgaggagctcatcaatcttctactcaagtttgaaattaaagaagtgattttggaatttactaaacagcagaaagaagaagatacaattctagtatttaatgttactcagttaggaacagaggccacaatgagaacatttgacttaactgtggtatcttatttaaagaaaatcagcttggattatcatgaaattgaaggatccaaaaagaagccccttcacttgattagctcttctgacaaacctggattagatcttttgaaagtggagtatattaaggctgataagaatggacctagttttcaaactgcttttggaaaaactgaacaaacagttaaggtggccttttcatctttaaatctgttgctgcaaacacaagctcttgtcgcttctattaattacctcacaaccattattccatctgatgatcaaagcataagtgttgctaaggaggtacaaatttcaactgaaaaacaacaaaaaaattcaactctgccaaaagcgattgtatcctccagagatagtgacattattgatttcaggctatttgccaagttgaatgctttctgtgtcattgtttgcaacgaaaagaacaatatcgccgaaatcaagattcaaggactggattcctccctttctctccagtcaagaaagcagtcactttttgcccgactagaaaatattattgtcacagatgttgatccaaagacagttcataagaaagctgtgtcaataatgggaaatgaagttttccgttttaatttggatttgtatccagatgctactgagggggatttgtatactgacatgtccaaagtggatggtgtgctgtctctgaatgttggctgtattcagattgtctatcttcataaattccttatgtcacttctgaacttcctgaataatttccagacagccaaagagtctctgagtgctgccactgcccaggctgcagaaagggctgccacaagtgtgaaagatcttgcccagaggagttttcgtgtttccatcaatattgatttgaaagcaccggttatagtcatcccacagtcttctatttccaccaatgcagtagtggtagatcttgggttaatcagagttcataatcagttcagtctggtgtctgatgaagactacttaaatcctccagtaattgatagaatggatgtgcagctaacaaagcttacactttataggacagtgatccagccaggcatctaccatcctgatattcagctgttgcacccaattaacttggaatttcttgtaaatcggaatctagctgcatcttggtaccacaaggtgcctgttgtggaaattaaaggacatcttgattcaatgaatgttagtctaaatcaagaagatcttaatcttttatttaggatactaacagaaaatctctgtgagggtactgaagacttggataaagtgaaaccaagagtacaagagacaggtgaaattaaagagccccttgaaatctctatatcacaagatgtacatgattcaaaaaatactttaacaactggagtggaagaaattaggtctgtagacatcattaatatgctgctgaattttgaaattaaagaggttgtggttactttgatgaaaaaatcagaaaagaaaggaaggcctttacatgagctaaatgtcctgcaacttggaatggaagctaaagttaaaacctatgacatgactgctaaagcttatctaaaaaaaattagtatgcagtgctttgatttcactgactctaaaggggaacctcttcacattattaactcttctaatgtgactgacgaaccccttctgaaaatgttactgacaaaggtaactagtttcatttctaggattctttaatat

SEQ ID NO: 9662 - DNA, 479 bp, Homo sapiens
gcttgtttgaggtgagggcttaaaactcagtaatgaaaaagagggagaactataggctaaaagggtgtgtgttcttaattgattaattgcaagcagctatgtagggcaccctgtgtttaaatcagtgctagctgtattatcttgagcaagtcattgtacctctttgtttttttaatttatttttattttttacatttttaagagacagggtctcactatgttgctcagtttggtcttgaactcctgggctcaagtgatcctcctgccttggcctcccaaagcgctggtattacaggtatgggccatcacgcctggcaaatcgttgtacctctttgagcctcagtttcctcatttgtaaactagtaggatgcctggaagttcataagcattaataaatgttagcaatagttattatttcttgagacggagtcttgctctgttgcccaggctggagtgcagtggcgcgatctaggctcact

SEQ ID NO: 9663 - DNA, 418 bp, Homo sapiens
aatattttacttagattatctttaagtaaatataaagcaaaaaggctgtgttctcataaaatgcatctccctttgttctttttaaaagaccataatagctagattgtgttcacagatctatcccaggaggccataaaagtccaagatccaaatccaagatccaaatccagtatggttgcccaaaaggacaagactacacactgtctcttattcttcacccccaggcaaaaaggcaagaactcttcattgaaagcaccaagggaattagaaactcatcttttctctttaggacactgctgtcttttttttttttttaaagttaaaaatggtaaacactttctttaaaattcgatgtcaattcccactaataacaatactttttttttttagctaataaaacagttgctcctatattttt

SEQ ID NO: 9664 - DNA, 410 bp, Homo sapiens
taaaaatgcagattctcaggctttctctagaccaactggatcagaagctctgggggtgaggcccagtattctgtgttttaacaagcccgtcagaaatttctgatgcacagtaaaatccgagaaacactggtttaagaaaaaccttgtaatgatcgaatacccactctgatgttttgccagcaaagggatatctaatatttcagaagcctctgagccagtctttgaaaaaatacaactatggcatctgcagcacaaatatttaaggacatcagaagcatgtcaaagctatttttaaagagagaaactgtataagatgtttacttcatagaggtttatgttttatggcaggctgaatgtttatctcaaaagttaaattatccattctccaaagttaaattatatatatatat

SEQ ID NO: 9665 - DNA, 1427 bp, Homo sapiens
tttttttttttgtattctaatacagttcaaatcagtgtggctggttcatttcaactccttcactaccaaactaggaggcagggactggcttcagtttttctgccttctctttttcactgatgaccagggtataaagatatctgctgcatcgaactttaaacttcacattgtccttatttttcttgatcttgacagattcagcatcctttcattgggctgtgaacagaaagtccttgatttcctcaattttcggaggcatggcgacaaggcacgcagggagcaggcgcggaccgggacagcgtgcggcgaccgggaaaaacagatttggcatctgctctttggtgatggacccagaagaaacttcagtttatttggattattactatgctacgagcccaaactctgacatcagggagacccactcccatgttccttacacctctgtcttccttccagtcttttacacagctgtgttcctgactggagtgctggggaaccttgttctcatgggagcgttgcatttcaaacccggcagccgaagactgatcgacatctttatcatcaatctggctgcctctgacttcatttttcttgtcacattgcctctctgggtggataaagaagcatctctaggactgtggaggacgggctccttcctgtgcaaagggagctcctacatgatctccgtcaatatgcactgcagtgtcctcctgctcacttgcatgagtgttgaccgctacctggccattgtgtggccagtcgtatccaggaaattcagaaggacagactgtgcatatgtagtctgtgccagcatctggtttatctcctgcctgctggggttgcctactcttctgtccagggagctcacgctgattgatgataagccatactgtgcagagaaaaaggcaactccaattaaactcatatggtccctggtggccttaattttcaccttttttgtccctttgttgagcattgtgacctgctactgttgcattgcaaggaagctgtgtgcccattaccagcaatcaggaaagcacaacaaaaagctgaagaaatctataaagatcatctttattgtcgtggcagcctttcttgtctcctggctgcccttcaatactttcaagttcctggccattgtctctgggttgcggcaagaacactatttaccctcagctattcttcagcttggtatggaggtgagtggacccttggcatttgccaacagctgtgtcaaccctttcatttactatatcttcgacagctacatccgccgggccattgtccactgcttgtgcccttgcctgaaaaactatgactttgggagtagcactgagacatcagatagtcacctcactaaggctctctccaccttcattcatgcagaagattttgccaggaggaggaagaggtctgtgtcactctaa

SEQ ID NO: 9666 - DNA, 680 bp, Homo sapiens
  misc_feature (21)..(21): n is a, c, g, or t
  misc_feature (27)..(27): n is a, c, g, or t
gcgataacccgctaacagctncctttncattgggctgtgaaacacaagtcctcaattttcggaggcatggcgacaaggcacgcagggagcaggcgcggaccgggacagcgtgcggcgaccgggaaaaacaggacagaaaaagacagacagcttttaaagctcctggattaaccctagaggctacccctaaatggagataagccatttatacagagaggtgttcctgctcgcttcagcaggtttgagaagctctggactaaccaccaaatgactaggaaaaatttgccagggctagtattttgggcatccctgtttaacccttctcaggagattcccaggcctgggatcgtatcatacacaagtcgccatgactcaggaggtggatgtttctgggaagacctgcaaaggaggatgacacttgcacccttcaagtcttcagaatgcctagaaaacactcaggacgcatttcactgaccaacctagtgtgaacctggaggtgtctctacgtgtttgtggttttgatcatcctgagagaggacctgaacggcctcttcacacccagtttcaccaaccacacaaccgtatttctggtttatctctgcatctttggtgtttcctaatttctatttatgcttgcttgttgtatgagtaggtaaaataaatccttaattaattaatgg

SEQ ID NO: 9667 - DNA, 871 bp, Homo sapiens
tttttttttttgtattctaatacagttcaaatcagtgtggctggttcatttcaactccttcactaccaaactaggaggcagggactggcttcagtttttctgccttctctttttcactgatgaccagggtataaagatatctgctgcatcgaactttaaacttcacattgtccttatttttcttgatcttgacagattcagcatcctttcattgggctgtgaacagaaagtccttgatttcctcaattttcggaggcatggcgacaaggcacgcagggagcaggcgcggaccgggacagcgtgcggcgaccgggaaaaacaggacagaaaaagacagacagcttttaaagctcctggattaaccctagaggctacccctaaatggagataagccatttatacagagaggtgttcctgctcgcttcagcaggtttgagaagctctggactaaccaccaaatgactaggaaaaatttgccagggctagtattttgggcatccctgtttaacccttctcaggagattcccaggcctgggatcgtatcatacacaagtcgccatgactcaggaggtggatgtttctgggaagacctgcaaaggaggatgacacttgcacccttcaagtcttcagaatgcctagaaaacactcaggacgcatttcactgaccaacctagtgtgaacctggaggtgtctctacgtgtttgtggttttgatcatcctgagagaggacctgaacggcctcttcacacccagtttcaccaaccacacaaccgtatttctggtttatctctgcatctttggtgtttcctaatttctatttatgcttgcttgttgtatgagtaggtaaaataaatccttaattaattaatgg

SEQ ID NO: 9668 - DNA, 1023 bp, Homo sapiens
  misc_feature (28)..(28): n is a, c, g, or t
  misc_feature (940)..(940): n is a, c, g, or t
  misc_feature (948)..(949): n is a, c, g, or t
  misc_feature (953)..(954): n is a, c, g, or t
cgcgaaacatagagctaggtacgaggcngcgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaattcagggtgaatggactggtcccgctcctgagttcactgctactcagcctgaggttgcagactggtctgaaggtgtacactggctattagaatcctatgaaatggggcactgccgaaaaggttggcccgctgcgccgttggttgggcccccggtttcgttntttcttcnnggannggggggaaactcttctaaaaaccggcttggggagaggggggtcgctcgtgctattgcatatcatacggg

SEQ ID NO: 9669 - DNA, 1062 bp, Homo sapiens
  misc_feature (28)..(28): n is a, c, g, or t
cgcgaaacatagagctaggtacgaggcngcgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaattcagggtgaatggactggtcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaa

SEQ ID NO: 9670 - DNA, 1072 bp, Homo sapiens
aagcagtggtatcaacgcagagtggccattacggccgggggtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaattcagggtgaatggactggtcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaa

SEQ ID NO: 9671 - DNA, 993 bp, Homo sapiens
  misc_feature (28)..(28): n is a, c, g, or t
  misc_feature (952)..(952): n is a, c, g, or t
cgcgaaacatagagctaggtacgaggcngcgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaattcagggtgaatggactggtcccgctcctgagttcactgctactcagcctgaggttgcagactggtctgaaggtgtacaggtgccctctgtgcctattcagcaattccctactgaagactggagcgctcagcctgccacggaagactggtctgtgatgggtggggcccctggntggggtaggcgggttggctggccttagcccatggaccgctt

SEQ ID NO: 9672 - DNA, 1021 bp, Homo sapiens
  misc_feature (938)..(938): n is a, c, g, or t
  misc_feature (946)..(947): n is a, c, g, or t
  misc_feature (951)..(952): n is a, c, g, or t
cggctagtggatacggtgtgatcggccgatgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaattcagggtgaatggactggtcccgctcctgagttcactgctactcagcctgaggttgcagactggtctgaaggtgtacactggctattagaatcctatgaaatggggcactgccgaaaaggttggcccgctgcgccgttggttgggcccccggtttcgttntttcttcnnggannggggggaaactcttctaaaaaccggcttggggagaggggggtcgctcgtgctattgcatatcatacggg

SEQ ID NO: 9673 - DNA, 1035 bp, Homo sapiens
  misc_feature (952)..(952): n is a, c, g, or t
  misc_feature (960)..(961): n is a, c, g, or t
  misc_feature (965)..(966): n is a, c, g, or t
ccccgcccccccccccccaccaaaagcgctaggtagcgaggcctgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaattcagggtgaatggactggtcccgctcctgagttcactgctactcagcctgaggttgcagactggtctgaaggtgtacactggctattagaatcctatgaaatggggcactgccgaaaaggttggcccgctgcgccgttggttgggcccccggtttcgttntttcttcnnggannggggggaaactcttctaaaaaccggcttggggagaggggggtcgctcgtgctattgcatatcatacggg

SEQ ID NO: 9674 - DNA, 1065 bp, Homo sapiens
  misc_feature (982)..(982): n is a, c, g, or t
  misc_feature (990)..(991): n is a, c, g, or t
  misc_feature (995)..(996): n is a, c, g, or t
aaacctatacgggcataaagagatagcatgatggcccctcggtgagtggtttttaaaatcaggccgagggctatgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaattcagggtgaatggactggtcccgctcctgagttcactgctactcagcctgaggttgcagactggtctgaaggtgtacactggctattagaatcctatgaaatggggcactgccgaaaaggttggcccgctgcgccgttggttgggcccccggtttcgttntttcttcnnggannggggggaaactcttctaaaaaccggcttggggagaggggggtcgctcgtgctattgcatatcatacggg

SEQ ID NO: 9675 - DNA, 1472 bp, Homo sapiens
  misc_feature (1389)..(1389): n is a, c, g, or t
  misc_feature (1397)..(1398): n is a, c, g, or t
  misc_feature (1402)..(1403): n is a, c, g, or t
ttcaccatcttgggcaggctggtctcaaactcccgacctcgtgatcccggcctcccaaattgctgagattacaggcgtgagccaccacgcctgaccaataaaagtattttctaaatatttaaacatttctgttataaattagtatattgggataaatttattagaatattctattatatcctctttactgaacacattactaagttggtaattggagaatatgagcaagattcatgttagttatttttaataaaacaggtattactgtctctaagccagacctgatcacctatctggagcaagaaaaagagccctggaatatgaagtgacatgagatggtggatgaacccccagtaaagacagggttcaccatgttggtctggttgatctcgaactccttaccttgtgatctgcctgccttggcctcccaaagtgctgggattacagtaacaatgctgcagcttttccatgctacctgcatgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaattcagggtgaatggactggtcccgctcctgagttcactgctactcagcctgaggttgcagactggtctgaaggtgtacactggctattagaatcctatgaaatggggcactgccgaaaaggttggcccgctgcgccgttggttgggcccccggtttcgttntttcttcnnggannggggggaaactcttctaaaaaccggcttggggagaggggggtcgctcgtgctattgcatatcatacggg

SEQ ID NO: 9676 - DNA, 1006 bp, Homo sapiens
  misc_feature (28)..(28): n is a, c, g, or t
cgcgaaacatagagctaggtacgaggcngcgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagggtgaatggactggtcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaa

SEQ ID NO: 9677 - DNA, 1031 bp, Homo sapiens
cccacgcagtcgtaacatgctccgtcatgttggtaggtgagtgggcctgcactggccgagattgacctggctaggagctgcagtggctacctgcagaataaggtgcgggaccagcagctcgtctactcggccggggtctaccgcctgcccaagaactgcagctgacccatcggccgagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaattcagggtgaatggactggtcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaa

SEQ ID NO: 9678 - DNA, 897 bp, Homo sapiens
  misc_feature (28)..(28): n is a, c, g, or t
cgcgaaacatagagctaggtacgaggcngcgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagggtgccctctgtgcctattcagcaattccctactgaagacagctcccactgctcaggccactgaatgggtaggagcaaccactgactggtcttaagctgttcttgcataggctcttaagcagcatggaaaaatggttgatggaaaataaacatcagtttctaaaaaaaa

SEQ ID NO: 9679 - DNA, 1405 bp, Homo sapiens
ttcaccatcttgggcaggctggtctcaaactcccgacctcgtgatcccggcctcccaaattgctgagattacaggcgtgagccaccacgcctgaccaataaaagtattttctaaatatttaaacatttctgttataaattagtatattgggataaatttattagaatattctattatatcctctttactgaacacattactaagttggtaattggagaatatgagcaagattcatgttagttatttttaataaaacaggtattactgtctctaagccagacctgatcacctatctggagcaagaaaaagagccctggaatatgaagtgacatgagatggtggatgaacccccagtaaagacagggttcaccatgttggtctggttgatctcgaactccttaccttgtgatctgcctgccttggcctcccaaagtgctgggattacagtaacaatgctgcagcttttccatgctacctgcatgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaattcagggtgaatggactggtcccgctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaa

SEQ ID NO: 9680 - DNA, 1144 bp, Homo sapiens
ttcaccatcttgggcaggctggtctcaaactcccgacctcgtgatcccggcctcccaaattgctgagattacaggcgtgagccaccacgcctgaccaataaaagtattttctaaatatttaaacatttctgttataaattagtatattgggataaatttattagaatattctattatatcctctttactgaacacattactaagttggtaattggagaatatgagcaagattcatgttagttatttttaataaaacaggtattactgtctctaagccagacctgatcacctatctggagcaagaaaaagagccctggaatatgaagtgacatgagatggtggatgaacccccagtaaagacagggttcaccatgttggtctggttgatctcgaactccttaccttgtgatctgcctgccttggcctcccaaagtgctgggattacagtaacaatgctgcagcttttccatgctacctgcatgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgcagctcccactgctcaggccactgaatgggtaggagcaaccactgactggtcttaagctgttcttgcataggctcttaagcagcatggaaaaatggttgatggaaaataaacatcagtttctaaaaaaaa

SEQ ID NO: 9681 - DNA, 435 bp, Homo sapiens
ggtcagataccaaaggtgggtgattttccctaaactgacttaggattcttgctctaattggattctacaaaagcagagagggaaacccaatgtctgcttactcagaaaggactcagaggaggctggctcaagtttaggtcaatgaagagagtctatcaccagctctgctgtaaaaccaaagttagctgttttataaatgtgttgtactgactgcatatgtgttctgttttaaaaacagaagaaaatgaatgagttatttcattaaaaaatgtaaataatttatgaaaaaaaattatgttgatttatgtgtgtgaccttggttgtgttgtgttttgtttacccctgctctctgtatcagtgcctttccgcggcgggggtggtggtgggggaatcctggtctattgtttttttaaaaaacattgtgtatagtttaag

SEQ ID NO: 9682 - DNA, 505 bp, Homo sapiens
gaagctcctgccctcctaaagccgaagccaaagcgaaggctttaaaggccaagaaggcagtgttgaaaggtgtccacagccacaaaaaaaatgatccacacgtcacccaccttccagtggcccaagacactgcgactctggaggcagcccaaatatccttggaagagtgcccccagaagaaacaagcttgaccactatgctatcatcaagtttccgctgaccactgagtcggccatgaagaagataggagacagcaacacacttgtgttcatagtggatgttaaagccaacaagcaccagatcaaacaggctgtgaagaagctctatgatattgacatggccaaggtcaacaccctgattcggcctgatggagagaagaaggcatatgttccactggctcctgattatgatgctttggatgttgccaacaaaattgggatcatctaaactgagtccagctggctaattctaaatatatgtatatcttttcacataaaaaaattaa

SEQ ID NO: 9683 - DNA, 425 bp, Homo sapiens
aggtgcatctgctcgggtgtatataatctctgtgaactgatggtcatgtggtgtcaataactctgatttattgaggggctgctaatgattgacattcatatattgctttactgtttatcaagcacattactgtaagttacattaattaatattcacattgaccctttctggaagatgctattaaccttctttggatgagagatttttattgtaggagagataagagggagatgagctgattccacctatctctactaaaaacacaaaaatgagatgggcatgttggtgcatgcctgtaatcccatacttgggagcctgaggcaggagaatcatttcaacctgggaggcggaggttgcagtgagccaacattgcgccactgaactctatcctgggcaacagaagtgagactccatctcaaaaaaaa

SEQ ID NO: 9684 - DNA, 411 bp, Homo sapiens
ttttttcatcttctgggagcacagaataggcttctgctcctttaaataactttaacaggcaccaaaggaacactgctagctctttcttaattctgtaggtccacatttaggaaaaagaaattgtcagcctctgacttatttccagcttacaaaaaggctgtgatgttggcagcccggggaaagcagttcccgtgagtcatgctttcacctttcagccagtgaagaacaggaaatagtcacatcactattgccaacaagcacagcgaatcgcttccaccaccgggctttcccagatgacgtcagtgagccaagtgcagggcatcacccttgccagatggccccggaagagtctcagctgccctgtcaagtttagcttctcaagctccccagaaccagcatggcaaggatcac

SEQ ID NO: 9685 - DNA, 1774 bp, Homo sapiens
cagcggcttcgcgcagaggtggaagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcatttttatgatttttat

SEQ ID NO: 9686 - DNA, 1909 bp, Homo sapiens
cagcggcttcgcgcagaggtggaagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggtcctgtgggaagagcagcgtggaggtgggctgaggttagaaggtgcagagcgtggaagaagattgtgagctgagtattggacatctgttcttgaatagtccctgggcctgccataggaaaggaagttctccagggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcatttttatgatttttat

SEQ ID NO: 9687 - DNA, 1224 bp, Homo sapiens
cagcggcttcgcgcagaggtggaagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggttacagttcttatccgcgtgaatacacatggctctgttacgaaaaatcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcatttttatgatttttat

SEQ ID NO: 9688 - DNA, 659 bp, Homo sapiens
ctttttccccctccccccccgccccgctttctctccccccccccgccccccccaccccctcggttgacaacacagccatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcatttttatgatttttat

SEQ ID NO: 9689 - DNA, 496 bp, Homo sapiens
aaagtggcaacagcctcggcactagggggtttgtatctaggagaacggccgatccgtcagcgctggcttcagccccaggcctcagataagttgggcactgggaagctcagatgagacatcttgctagctcctgttttattccgctccaaacctggagctgagctgaggccatggtcaaagccgactctccagtacccccagaagacactaagccatatgcctctcccccaccatcatttcttttgtcgttttaacagctgaactttgttcgattttatctccctctacttatccaccaacacgagaaagtcatctatttggacgatgatgtaattgtacaaggtactctcgctaactgccaagaacacttggaaaagaagcagctgataagtagaataactgtctctcttcatttttcaaataactaattgtgcagcaagttttgactgcttatttaagttgtgagtacagtattgttgtaaatgtggaagtattt

SEQ ID NO: 9690 - DNA, 525 bp, Homo sapiens
tgtgtcttttcctccagaacagcgttgttttttgcatgttttgcacttagccagaggaagtctggcgcatccgagccggccagccgagcacatctggaagtggtttctggggccgcccctctctgccagcgcaactcctgggttcccagcggcttcgcgcagaggtggaagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggtaaatagagaaatttacgagcagtgtgcagtcgttccgttttatcctggccggtctgcagcagttctttattctgctacagacccaagaaagtaaatcagaggtgtcagattg

SEQ ID NO: 9691 - DNA, 1968 bp, Homo sapiens
cagcggcttcgcgcagaggtggaagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggtcctgtgggaagagcagcgtggaggtgggctgaggttagaaggtgcagagcgtggaagaagattgtgagctgagtattggacatctgttcttgaatagtccctgggcctgccataggaaaggaagttctccagggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacagtgattactaaaggaaggagatctacatgtatttttcacatgaagatctccttaacagtgattactaaaggagatcttcatgtgaaaaatacatgtagatctcctttagtgaatcacatgaagatctccttaacagtgatgtcgacc

SEQ ID NO: 9692 - DNA, 1913 bp, Homo sapiens
cagcggcttcgcgcagaggtggaagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggtcctgtgggaagagcagcgtggaggtgggctgaggttagaaggtgcagagcgtggaagaagattgtgagctgagtattggacatctgttcttgaatagtccctgggcctgccataggaaaggaagttctccagggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggagtacgtgaaggcttctctaccattttttccatgcttggaaacaaaatcattcaattaattttccacacatagttcaagggttagaaatatttcacagtcatctcaggtcagattttcttacagaggcaatgttaagaaagaaaagggggcagtcaattaaaacctttcctcaaaagatataaatcagaggaatcaagatcctgtggagcgaggagtccctgattatacattttcctagtaagctgttgaaaaatgtgacttgaatcttttcccccaaacaatcttcatttatcttagttgagtttcccctcctaacatagatttttttattaaggattattatataaagtcaattttgctttttaaggtttatttttataatttataatttttcgttatcggagttttaaaatagagaagataaaaataagtctaatacaagcactattatcccatcattgtattgcctagcagtcttgtgtatctggatattttaataccatcataaccttgaatttgcaagtaaagttattctaaataatgtaggattcgaatttgatctcctgtgtctactatttaaaaccctgggagttaaaatggcaaaatattaacactgttactctaggtcatgtatataggagttcatggtattcttactataatgtgtatgtttgacaattttcaaaatgaaaatttgaggggaaaaggccctggccat

SEQ ID NO: 9693 - DNA, 476 bp, Homo sapiens
ctcttacttaaaaactgccgttttctctgaaataagttatgggcagtcacctgcgagaaagtgatggaatgaagcttttgaatagtggtagcatttgggccggcatgttgatccacccgccttggcctcccaaagtgctgggattacaggcatgagccactgcgcctggcttcatttagaatatttttaaacagattagataaccatgagttttgagtgtgctgatagaatttttataggtgacacatgtacattgtttttgatagcaaaagaaaaatcacataatgcaaaagtgttcaaacatctatttttagtaggggagtaggtgtcagtttgtatgttaactataagtaaagcttaatatcaattcactttcttgttaagacttattgtaataattttaaacagaatcaagcctctgaattctgaaatttggaatgtattaacacagaaaagactttacatgctttgtgtta

SEQ ID NO: 9694 - DNA, 1610 bp, Homo sapiens
ggaccgtgtctcttaagaggagggaaaaaaaggacagcgagttggtaatggaatgttgctggatggattacatagatgagacatgggagatagaatagagaatccagaaattctcatgtatgtgtgcgtgtttagtataataacagtagctcacatttgctgagcatttgtgtggcaagtactggagtactttttcaggttatcttatttaactctaacatttctgtaaggtaggtgcaattgttatctccatttcacagagttgcccaaaaccattacttttaaacgctggagccagacaactccagaaatctctgtggtagccagtaaactatacatgacaaattattggtcagtaggaaaaagatcattcgggaaatggcggtggctcacgcctgtaatcccagcacgctgggaggccaaggcaggtggatcacctgaggtcaggagttcgagacgaccctggccaacatggtgaaatcccatctattaaaaatacaaaaagccaagaaaaacaaatattcaattaacaaacggaaagttgtcccacttccaaacagttgttttttgtctatcattgttgataggggtgtgggatacaattactgtcaggcatttttggtgtgaaggtgaaattggtacaaccctatttaccaaaatttaacatatgcattagcctttgccccacagctgtctcatttccgaggcatataccctaaggaaaataagggattcataaggatactatttgccaccttttttaaaaataatgcttctagaaacaagtgtccatcactaggacactagttaagaaaattatgattggtacatgcaatggaatactcttgacccattaaaaactgatggaaagttctttatttgcattaaagtatgtccaaaaaatatagtttcccctcaggaaaaaaaaagcagaatgtagtttagcaagtacagtgctgtcctaatgtgaatatatgtgtgtacatatgttaatataagtgtacaaaaatatctggaagaaggtcagtcaaaatacaagtgttttacattttgtcttttggactttttatctggttggtgttttttgtaatttattattttacaaaaacaaagttgtgttttatgttttaattaaagctgtgccagtgaaaagggagccagttgactcttgaccttcacaagtaggtaaccatgatgaagtaactatgtctggggatctgagtctcagcttttttgtgtctataaatttgattatattcatttacctatagttggacaagctaacctaccacctggacatcatagttttgactccccaaattggactgggtatccattctatgtgttctctgtgtgcctgtcatggtatttgtcacactgtactgtaattccctctgtgccagtagattgtttgctcctgccatacatatacacatgcacatacatactttttctgctatatgttacacatttcttttgatttattatttgtcatctacatttgtatacagaagttttaattttcattagccaaaatgctaatgaaatcacatagatattaaagggatacttggaacaactttatgccaataaattcagtaacttaagca

SEQ ID NO: 9695 - DNA, 392 bp, Homo sapiens
ggcaccactttggagaagatacagacagaggagtgcacagtttgttgagcctccagcttgatgtaagaaataatatgctccttcctctgagtggacagagccacacatcagggcgcgacctgtacatctatacacaatggccctacaatgtagtcaacattttattcccctcatttagagctctgttgtctctgagagggtttaggttggatgtaccttttaattaaaaggactttggctcagaagcaccccaaaaaatcctggttggcattcaggagggaagagatagatcttgtgacttggcttaggataaaagttggtagtaagaggaggtccttgaagtttatgtgttatctggtctagattactaggatggaagcccagagcagaag

SEQ ID NO: 9696 - DNA, 458 bp, Homo sapiens
tcaaacacctgacctcaggtgatcgcctgcctcagcctcccaaagtgctggcattacgggagtgagccaccacgcccagcgcaatctgtgttttaaatgtgcactattaagagggatatttgaggtcttactgtggatactcaatactaacattatactattttaaatacagcatctactcatctttctattactattcaacttgaagcaaatattcttgccattattatttattttcaaatattataccaaccttgcccttttgctttctttcttttttcccctgaatagccaatcataagtggaaagtcattgagtttatttacacccttcattttgccttgattcttgtaagctgaaaaacaatatcctttctgggtatacaatagaaagactttaaaaacaattggcttgtgaatattgttgtgaatattgttgaaactagcttgtaacaatgt

SEQ ID NO: 9697 - DNA, 204 bp, Homo sapiens
agaaggatagcttgagatgagactattttgaagatacatggggtggatattcaaagtgccttttacatagttactgtcctccacagtttccccattaaatgtggaatccttgtgattgcattcttggagggccatcgaaaactagtgaagcacagagagactattttttttctatagatattaatctaaagcaataattggcaa

SEQ ID NO: 9698 - DNA, 275 bp, Homo sapiens
tatgtcatgcatggaagctgcttccaaagagaccagatgttgccctgaaactgagacagagggtgcagcagaggtccctcctcttattgtaaagctaggaagacacccccaaatcatttgcatcagtagagtgactaggtttgtgattttctttatatacatatatatatatatatataaaacatacatatatgttatatatataaaacatacatatatgttttatatatatatatataacatacatatatgttatatatatatataacaaaaaa

SEQ ID NO: 9699 - DNA, 586 bp, Homo sapiens
accgcgcctggccagcaatagttatttttaaaagatcctcctacatgtgattatatgccccttttcatttgagggtagtagaccatatggagaactgacagtggttgagagatttgaagggaactaatagtccagccaaagagcgaaaaatggcaggaaattggaaattaggtctgtctcattggctttattaaccaaaatgaattgggaatctcaatgtaattgatcaggaaggagctccagtcattcctggaggattaatttattattattattattattttttagctgcataccatatcactgtggtgcctttgtttttggaatggagctgttgcctgctgaccacgcctgggggcacctaatcacaagtctttcccaacttctttttcctttaaagcaagccactccagttgaaagagaatgattagacatatgaaagtgtggttttgtttgcccaagagtttatgtataagttaacacattgtacacttttttttttttttaaacttcctctttctctcttatctgcctctgatcacgggatcctggttagttttgctcagggcagctcgcttgacctggt

SEQ ID NO: 9700 - DNA, 434 bp, Homo sapiens
taaatcgtgtgcattcctggaatacatcacacaccttggcatcacatatttcctattaatagttctacaatattctctcatgcatccccacatccaccacaccccgagggcaccacactctttcagggcactgctgactcattcttcagtcaacacacagtcaagaatcatcttctcccgaaagctcctgccccctcacctcccacacgccccagggtccttcaggagcaccttctgttgctgcacttgttgccttgttttttaatttctggcttcttttcctatgagttcctgaagggcagggatatattcttctccatattcccagggcccaacacagttccttgtgtgtaagtggtaagccagccgatttcagccctttttcctttggttgtaaccggcttcattccaagataagattgagtcatgctaaa

SEQ ID NO: 9701 - DNA, 329 bp, Homo sapiens
aattctgagcaaatgatggttaggtgattttttaagaaaaacccaaggctagccctactcgggaagctgggatgggaggattgcttgagcccaggaatttgaggctacagtgagtgatggtgttaccactgcacttcagcctgggtaacatagcaagactggtcttgaaaataaaggaaagcggggaaccgggaattatggctcatgcctgtaatgccaatagtttgggaggctgaggcaggaggatccctgagctcaggagttagaggagttaacgattgcgccactacactccagcccaggtgacagagtgagaccccatttcaaaa

SEQ ID NO: 9702 - DNA, 453 bp, Homo sapiens
attagctggatgtggtggtgcatgcctgtagtcccagctacttaggaggctgacgtgtgaggattacttgagcctgggacatcaaagctccaatgagccatgatcacactgtactctagcctggagaatagagagagaccctgtttaaaaaaaaaaaaaaaagggaaaatgggataatgtttacatatcactccacaacctgggcatccttgaattttctggctgaggaagaagagaagaaggaaaaataaaaatacataggaccttcacaagctattccttctacctggaacatgttcccacttctgcccttctctcactcatgcttagggtctcagtttcaaggtcactccctcctggagacatgcctaaacacccccaaacccgaaggtgggctctgtccaattagcagtgctcccctcaggtctgtgagcatgggatggctcagcccac

SEQ ID NO: 9703 - DNA, 503 bp, Homo sapiens
gtttatttcataattttgataaacgtaccacatttcacatttatgtaaatattatataaaatgtaagccttgcaattttcctctaaattttgaagtactcaaaaataaaatgtttatttaaaaacttcaaacacatagcctagtttctttttctttgtgtaaaatgttttgttgttgttgtttttaagagacagtgtctcactatgttgcccaggctggcctcgaactcttgggctaaagagatctctcacttcaccctcccaggtagttgggaatacaagagcacaccaccactgtaaaactttttatactggaaaaatttaaatattcatggaattaagaataaaataatgaatgcccatgtaccatacattttgtttcaatactcagaaacattttgccaatcggttgtttttgaaatagtttaaggcaaaggcatgacataatttcattttacctctagacacttcaatatgcatgtttaattgatacctgacttcaaa

SEQ ID NO: 9704 - DNA, 499 bp, Homo sapiens
tacaagtgtgagccattgtgccctgctaatttatggaaacttgagaagggttcatggatgagatagtgtggtgtttgaaagcattaaatgagaatagctcaattttattaaaatcatgcctctcctttatttatttaattttattttttatttttttagagagtcttactctgtcacccaagctgggctgcagtggttcattcatggctcactgcaaccttgaactactggtctcatgcaatcctcctgcctcactgcctccgcctccggagtagctagggctacaggcatggaaccaccacaaccagctgatttaattttgtgtgtgtgtgtgtgtgtgtgtgtgtgtgtgtgtagagacagggtgtctcactaggttcccaggctggtcttgaattcctggcctcaagcaatcctcccatattgaccccccaaagcactgagattacaggtgtgagccaccttgcttggccaaaatcatgcctctttttataggtaa

SEQ ID NO: 9705 - DNA, 588 bp, Homo sapiens
tgaatgtgagaggaaagggatggggtggtatgttttgttttgggtccaggggagaaaggcaaggttacaagaatgagtggcttgcaccactgactagtgatgacagattacttctatgccccttgactagtaaacattccaagggacatcgcgatggggtgaggttgctgctatcaagaccagtcacattttgaaaattaacacttgcttccttacaagctgccttccagaggtcaacagcttttcacaagtgaggcacccagttgctgacccttgatttctggaatgtagggggtcaggaatccttggtggcccccagagaaggttggggcacagtgtaacctatataaggaaggatcatactcactctttacatcaattagcaaaattttgaggaaaaagaatctcacttttaaaatgtaaatagctcttcattacccctccagacttaatcctaccagtaactcacaccttagtgtgaaattaataaacagcagctttggagatagctggaggtttgacttagaggaaaaagtaatttttgtagcaggacaattctgggaagatttgtatgggaaggagaaggtg

SEQ ID NO: 9706 - DNA, 510 bp, Homo sapiens
ttttgattataatagataataaaatctgaaagtgatcaaatttgctactttggagacattctgttcctttctctttattccttcacacttccatgggtagaatacagattcccagattttatgttcacaatgtcaggttcattaaaaaaagaaaaaaaattccgagattcttttgaagaaaagtttgatgaatattaattaacacatgctgaagagaaactgaggtgtttttctcttatactgcattcctcttctctctacccagctttaccaaagaaacagaattataataatttaaaaaaatgtgaaatatttcttttccaaaaattaaccaaaaccaaaaatcacaagatatttgaggaaaacaatctatgtgtcaaagagcgagatgaacaaaggaattgagctcagataatgcagagtacagcagagagctttaaaaaaaattgttattgtaagttcattgggactgcagagaatgatacatccataaaataagaataggctgct

SEQ ID NO: 9707 - DNA, 117 bp, Homo sapiens
tgcctctttgatcaggtctttattcaaaagaagctgtccaaaatgatttgacctttatggaataatcaaatttaagagtttatgcagcaggcttcttctcctctgtagtaggtttct

SEQ ID NO: 9708 - DNA, 464 bp, Homo sapiens
agaaataaatgtgttgcttattgcctaaaacactttctggcatataatatgtactcaaaaacataaaggatttttaaagaagcattaaaagaacatgtacattagaacataacaagtgatactaacataggtgataatgagtcaaaatttgggttcttgaaaaaaacaagatgaacacatagattgtcttagaaaacaaagctcttacattattagttaaatacattttttttcactgggatcatgtttgaaaactaaagttgtgggataacttgtatcttttgaggagcttaacattcctaggccagggaaataacaagcaaagaaataatttgattttatattttaaagttcatgcctgtaattccagcactttgggaggccaaagctgggggatcacttgagcccaggagttctagaccagcctgggcaacatagtgagactccatctctccaaaaaaaaa

SEQ ID NO: 9709 - DNA, 313 bp, Homo sapiens
cttcccacattctatgcattcataaggcttttgcagggtgaactttctggtgctgagcaaggttagagggacagccaaaggctctctcacattgtccccactcataaaacctttctgtgttgtgaactttctggtgccctgcaaggtggacatttctgctgtaggatttcccacacctgctgtacacataagggcttgctccagagtgaagtctctggtggtgaacaaggctggagctctggctaaaggatttcccacattctttgcactcataaggactttctccaatatgggttctttgatgttgaccaag

SEQ ID NO: 9710 - DNA, 529 bp, Homo sapiens
acagggtttcaccatgttggccaggctggtcttgaacacctgacctcaggtgatccacccgccttggcctcccgtagtgctgtgttacaggcatgagccaccgtgcctggccctgaatccattatttaaagttaagatatttttaaaaagagataactattgtgcctcttctcgtgatttaatgaggtatagactaaccacctatgaaatagtctttccaaaaatttagacagaaatctgatcaagccagtttatagaacatacattcaactgagaaacatgttaaaggactcttcttggatgctgtcagcaaaattcataatgttagaactctgcagaaaaaaaaaattgtttttcccccaacaaataaatctcataaaaaagaatatagattataaagaagcctaagagacatatcaacccttaataaaaggatcctgtttggctctgacacactaatgaaattggaagaataattagatatttgatgctagtaagggtatgctctatcgggtcctcaggtcagccc

SEQ ID NO: 9711 - DNA, 362 bp, Homo sapiens
tgcccttctttgggctttggtatctgccctcactgtcgtagggtatcagcctcccttagcccacttaagaaatggctctgcttttatttattttaagattttatttgaaaggagattcttttgacttttttttttttttttagtttcaaaatgactggactaagtgagccaagcacccctttttgctttatatcttgtctggtccgtgaacacccccttactctgagtgtttcagaccttgggaacaagaaatagtttctcttggctgggcgtggtgggctcacgcctgtaatcccagcactttgggaggctgaggcgggtggatcacctgaggtcaggagtttgagaccagcctggccaac

SEQ ID NO: 9712 - DNA, 766 bp, Homo sapiens
  misc_feature (676)..(676): n is a, c, g, or t
ccaagatggtccctgccctaggtaaagtcttcagaggacctcacacctcagaagtcatctctgctatgggctgtgaatcccaccatacctacaatgatctcagcatcctgcctttttgtgtcactccctcgaggttcaaagcccttggcaagaacatttgcagatgccccagctgtcagagagaaaagattatcttcctcctttagcttccacagtgggatgtgtgaccctgcctcctgcctattttaggactctgcctaaactaagtgttctggtgctaggtgaccaaaaccaaaaatccacgaacatgttctaacaaaataatgctgtgaaggtttcctgatgatccatgttactcccatagtatctcccctcttcctccctactacttaccagcaagagaccgtaccacctatttaggatcaatgtaaagcagagctaatatctgaaatcccagtttcttttcaaatgcttccctttccaaatttgaagccagaagaaacaatgtatcactgctgatgtcaatatgacttcctcggctgggcaccgtggctcacacctgtaatcccagcactttttgagaccgaggtgggcagatcagttgaggtcaggagttcaagaccagcctggccaacatggtgaaaccccaactctactaaaaatacaaaagttagcntcagtgtgggggcacacgcctgtaatcccatctacttgggaggctgaggcaggaggatcgcttgaacctgggaagtggaggttgcaacta

SEQ ID NO: 9713 - DNA, 274 bp, Homo sapiens
atatatacatatatatgtatatcctagtatatatgtatatatatatatacacatatatcctagtatatatatacacacatatcctagtatatatgtatatatatatcctagtgtgtgtgtatatatatatatatatatcctagtgtgtgtgtgtgtgtatatatatatatatatctcctagtatacagtaacacacctagtgtgttacctgcagcatctcacttaattcttaacagcaaccctgggaagtagatgttgtttcatttttacaggt

SEQ ID NO: 9714 - DNA, 6460 bp, Homo sapiens
  misc_feature (1281)..(1281): n is a, c, g, or t
gggtcctggagctctctcggcccggcaggtttcgctcccgcccctccggccttccacagctgtcctggccgcagggtgttcaaggcgggacacaccaggctagagatccgcgatcgggccccgcctcaggctctgtgcacacccctgcctggtgacctccattggtgctccagcgtgaacatggtgcaaagataccagtctcctgtccgagtctacaagtacccgtttgagctggtcatggcggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaagatcgcaggtgttgagcacgtggtcttcgtgcagacaaacatcttgaactggaaggagaggacgctcctcatcgaagcgcacaatgagaccttcgccaaccgcgtggtggtgaacgagcactgcagctacacggtccaccctgagaatgaagactggacttgcttcgagcagtctgcctcactggacattcggtctttctttggctttgaaaatgccttggagaagatcgccatgaagcagtacaccgccaacgtcaagagggggaaggaggtgattgagcattacctgaatgagctcatctcccagggtacctcgcacattccgcgctggacgcctgccccagtccgtgaggaggatgcccgcaaccaggctggaccgagggaccccagctccctggaggcccacgggccccgtagcaccctggggcccgctctggaggcggtcagtatggacggggacaagctggatgcggactacattgagaggtgcctgggccacctcacgcccatgcaggagagctgcctgatccagcttcggcactggttacaggagacccacaaaggcaagattcccaaagatgagcacatccttcggttcctgcgggctcatgacttccacctggacaaggcccgggaaatgctgcgccagtccttgagctggcgcaagcagcaccaggtggatctcctccttcagacctggcaaccccctgccctgctggaggagttctatgcagggggctggcattaccaggacatagatggccgccccctctacatcctccgcctgggccagatggacaccaaaggcttgatgaaggccgtgggggaggaggcgctgctgcggcatgttctctccgtcaacgaggaaggacagaagcggtgtgagggnagcacaaggcagctgggccgtcccatcagctcctggacctgcctgctagacctggagggactcaacatgcggcacctgtggcggccgggggtgaaggccctgctgcggatgattgaggtggttgaggacaattacccagagaccctgggtcggctgctcatcgtgcgagccccccgagtcttccccgtgctctggacactgatcagccccttcatcaatgagaacaccaggcggaagttcctcatctacagtggcagcaactaccagggacccggaggccttgtggactatctggatagagaagtgatccctgacttccttgggggagagagtgtgtgtaatgtccccgaaggagggctggtccccaagtccctctacatgacagaagaggagcaggagcacacggaccagctgtggcagtggagtgagacctaccattcagccagcgtgctccgcggagccccccacgaggtggccgtggagatcctggaaggagagtcggtcatcacctgggactttgacatcctgcgaggggacgtggtgttcagcctgtaccacaccaagcaggcgcccaggctgggcgcccgggaaccggggaccagggccagcgggcagctgatcgacaaaggctgggtcctgggcagggattacagccgtgtggaggctccccttgtctgccgggagggggagagcatccagggctcccatgtgacccggtggcccggcgtctacctgctccagtggcaaatgcacagcccccccagcagcgtggcctgcagcctcccgggtgtggacgatgtcctgacggctctgcacagccccgggcccaagtgcaaacttctctactactgtgaggtgctcgcctctgaggacttcaggggctccatgtccagcctggaatcctgcaccagcggcttctcccagctcagcgccgccacctcgtcctcctcctccggccagtctcatagcagctccctggtctccagatagccgggcccagtgtttcagggccgcccgctcgcctccagtgtccagaaatgtccagaatgagaagccagctaactgcagggcctgggaccatgtgggctggagccccaggcctagatgctgcccaagttggggtgtctggagcggatggcaaggatccagaactggcctgtgggtggtgtcagggctcttgaaattgcaaggacagaaccatctccttccggcttcgtgtaaggaagaccaagccaaggccaaggtgtctaccataccacacctttgggacatccgggcttagcgacgtcagccaggcccatctcctctctgtccacctcttgctctgctttcgccatgcaggggaccatcactatcaggtgcccttctcctccccgcagcttgcctgcataagagagcctcttcctcccaaaggctccagcacacttcccagagctgagtcttagcctggaagggggagcgattgccaggtcaattcctgaaccaatcacagttgccaggcacactggagaatgctgattggccagcagggtcatgcccaatctggaccaatcaccgtgatccagggttgcagtgaggtgcagtgattggccagcctggatcacatgcacatctctggaaccaaccacctgctctcaaaagcactagtgggtgcctcgaggagtactggggtcccccctaagaagaaggaggaaggatgctggggaggcagaaatgaagggtgtttaccttggcatctgattgcataacgttctgttatgcagtatcaagatgtgcttggtgagcagttaagtgagttacaggcgctgctctttgtggggaacagcacatcctgaagtgaaaatccatgttccctgcacttggccagcatggcctaagcctgaccatccctgattggagagggtgggagagccctgggtttctgctaagttccaggcagtgatggggtgactgaggctgtctgtataccccactggagatgcctttctctcctagggaactgtttaattatgactgtttttggttgtaagccacagagacccatgcccaggtgcttcaacacaaaagcatgatcattcatgggtgcatagaactggccagtccaggagggcttgcttcaggtaaggctagatccagggtctcaacatggagtctcgattccccccgcgagtggaggctgctgtgtctgccctggggcagatatgactctggaactaggttcaatattgacatgagttcccctagttactacacaggagcgtcttgggtctccttggggcctgaggacatttctcctttcctttcctggactccccaaaaggcagccagtcaggggtcaccaacttgaagcctgatctggcctgcttttagtgttgcttttttgcctttagaatggtttaaaaattgaggcatttcgcatcgaaatcaggatttctggcttcccttaggcatttgggagcaccagcagaatggggtcactattgttgcatgaagacaacacctctgcacccctggatgtggccacgccagtccctaccccattgacttgcgcccagcccacattacacatcctcatgacctgcgtggcaggagtctcactgacatggctctgtcagcagtggctggtacccttgtctcctggccttgcttagagttggggctcatctctgctgcagtaactgagccaaggggtggttttgtggccacaagaatcatctttatgcaggctcagcaatgcagggccaggaaacttatatctacgccagcctcaaccccaaacccaaggaagagagaaagtgtcatcttttcagatacatccttcttcctgctgggagagagccttgcccaccttcctgttggctctctgtccgcttctcaggtatctgaacaaaatagattgctttgcactctgcgtcaaggtgtgtgtgcacatgtgtgcataagagaccgactgattggaaggagacgttctcaaaactaattgctcccatatcaccaggcatttattgctgagagcaacttgcaatattttcaactatctttaagtgaatttctagcttttctcttaaaaactaggtgttatcctacaagtatgctgggataagctgccctggcagtctttatacatttattgtctagccccagagaaggacacagaagccttttacggaaggaagctggaactgcctgttccagaggcgggtggggggaggggagtctgctatcagctgtccacccttaacagtgggggtgaggaacctcaggccctttcagttctgctcttgagagtgctctctccctagggaaaaccagcccaaactggcttaagcaacaaagcaaattccctgggtcctgtactagggatggctgaaggtgggtgctgcttcagatatggctggatccaggagcttaatgtcctcaggcctctcaactgcacccaggcctcttgactctgcatctctttgcatgctgacctcattctttcttccacctggcgggaaagatggctgccagcagccccaagcctataatttcaggattcacactctaagagatgcttttccatctcaaatctcatggaaggctctgattggcccagctcgagtcacatgcttattcctgtgggccacactggcaaggaactagggtcccgtgattgacattccctgcagaagccgcagcaggattggggagggccattcccccaatggacaagagaagctggaccacagaaccagcaggtatccatggtggcatctgctacggccggctctcctcccatgtggaggtctcggggacccacgtggaagcattatcaaggtcattcttcttgccttcgggaggactggaattaaaaataatccaaggaagggattgccaagcttttggcttttgaatttcccctgagccacaaaggctggaagtgccttggcttgggcttcttgcatcattagttcattaatccattgtgaccaggacagaagcaacccacaagcagcattactgttggtgtttgggcacctgggccttgaatttaggccaggactcaaaccccagccttcctttcactagctgtgtaaccttgaccaggtgacttaacctctctgtgcctcagtttcctcatctgtaaagtgaggatagcagtgcctacctcaataggttgtagtgggacgaaatgagggagtagctgtaaagctttcagcacagctcccagaacacagaaagcgctccattaatgtcagtggtcattctgattacttaatgcttcgcatccaaagactcgttttcttcctgaggtcgcctatccctgtttttcgttattgcacccagagaaaagtaggtgtcaagaattattgccctctgagttgggtgtgcagtctttctcttttagaaactgcttgtgtgggcggggcgtggtggctcatgcctataatcccaacactttgggaggctgaggccggctgatcgcttgagtgcaggagttcaagaccagcctgggcaacatagtgagaccctgtctctacaaaaaattaaaaaatgagccaggcgtggtggtgcgtgcctatagtctcagctgctcgggaggctgaggcagaaggattgcttggaggtcaaggctggagtgagccatgatctcacccctgtacttcatcctgggtgacaaagcaagaccctgtctcaaaaaaagaagaaagaagctgcttgtgttttctgggtaagtccacccatctgagggagtgtattctgagtggtatttcccttggcagttagaaaatgttttttcccagaggttgaagtatggagagtttgagactctttttttctaccctgcactctctggaattccccctccctgctgtaaaatttattgtccaatgagaatagtataattgttttcaacaaagtctctttgagccagtgaaacacgatgggtttttttgtttgcctgatcacttgctccaaccagcagcattaaatgttttccatttggataaacttgcatcgtcagcttcctaaaaccctggaggtttcccgtgggctcgttcaagaactttccagctgttgtttaaaagactttagagctagcttgttcagcctgtggcctgcaggctgcacgcggccccggactgctttgaatgtgctccaacacgagttcgtaaactttcttaaaatactgagg

SEQ ID NO: 9715 - DNA, 226 bp, Homo sapiens
tggcctgcagcctcccgggtgtggacgatgtcctgacggctctgcacagccccgggcccaagtgcaaacttctctactactgtgaggtgctcgcctctgaggacttcaggtaggagggctccggagcggggtcctgggcaggaaggaccctggggctgattgacaatgcagatgcctggcctcctgtctcccagctgggtcagcttctcccggggtgggaccccag

SEQ ID NO: 9716 - DNA, 668 bp, Homo sapiens
ggacgcgtgggcgaccacgcgtccgggaaatccttttgcctaaattctgaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctgcctcttgtgtccctggaaccttctagaacacctgccttctaccctctggttgggagatgcagccaccacatcccttcatatcatactgttttgaataaattttcaaatccttattgttcagagttgtttgggggttctgtttcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggcc

SEQ ID NO: 9717 - DNA, 399 bp, Homo sapiens
tcagaaagtataatcctccaaatttcttattttttaacaatttctttttgtgatcttgtcacttggcatttccagatatattttaggagtggttttccaatttctgtgaaaaaagtcttctgggatttggtagggattgcactgaatatatataagttgacttttcacctataaagactctccttgtgctgaatttcagttcagctggtcatcgttgcttgtacaactctgtgatgaattgaaaatataattttggccttttgtttcttttatcctagttgttggagacggatgtcatgcctttcttaaccttgtgtgttctgctcaaaaatggaggttctcagccaggtgtggttgttcatgcctgtatccaagcactttgggaggccaagatgaggg

SEQ ID NO: 9718 - DNA, 747 bp, Homo sapiens
ggattacaggcgcctgccacagtgcccggctaatttttgtatttttagtagagacagggtttcaccatgttggccaggctggtctcaaactcctgacctcaggtgatctacccaccttggcctcccaaagtgctgggattacaggcgtgagccaccgcgcctggccctctgcagttgtttaataaggcacagaatacctgtagcataggtcagccttacgatgtccatgaattacatattcagacgttttagagcctgatacattttggaaaagaaaaacaacttctacacctattctacagtccgcatttaaaacaataaattcctctattaaaaacgtaaagccgggtttgcttgcgtgccacagggaatatatccaggaaggttattatgaagctgtcaaatcaagatgatgggaataaggcagtttgaacgaacagtcttcccacagtcaggccatttttgctgatttggtttagaattttcagaaatacttagtacactccacctgttctttgatgggaatatctaagaaggctaggtaggttcttagggttagcctgagtcatctaggggctcaactccttgtgaggggaaatgacagtgaacaagttagtactttgctccacaaatgcatgaaaggacaaatttgcatcttctatcagtatttaacttccttttgctaatgacaaataaatatatctatatttttacacaacaaacaaccaacaacaaacaaaacaaggg

SEQ ID NO: 9719 - DNA, 418 bp, Homo sapiens
ttcattcagcagatatttgctaaatgtataattaaataccaagatatcccccaactcccctagaagatatgaatgtataggttaataatcctttacccctcccaagaccttatttttaaaaagtaaaaataagcccatcctatctggataactgttatacaggtggtatattatacatgccagaggagaactgtaaacattaggatgatctgtgtaaatgatgctttggcacaacacctattttaagtacatttcatatgtctactgtgttcatcaagaaaattaatgtagttgggtgccttttgaaaatgcaaatatgttttatttcattgttttatatccttagcatatagttacatgtgatgaagacactgaaatgaaaaccctaataaattctttcttgtggaaaaaaaaaaaa

SEQ ID NO: 9720 - DNA, 468 bp, Homo sapiens
agccactctagtcattgtgaccttcacccttccaggatgacttcacctacagaggaaagacaggagggcctgggagcaactggctgctccagaaacacgcaatgggcccctcatgttcaatagaccaatatataagctgtggaagaaaaaagacattgctttttgagaagcttctataaaatctgctgtacaatattgtacttatagttaactatattgtgcacttaaagtttgttaggagggtagatctcttgttaagtgtccctgacacaaaggacatttaacaaaacaaaacagaaaataacaaaaccaaaggggaaagaagaaacttttggaggtgatggatacatttattgctttgattgtggtattttcccaggggtatacatacatatgtcaaaactcattgaactgtatactttaaatgtgcatatttttggtgtatccattatacctcaataaagctgt

SEQ ID NO: 9721 - DNA, 622 bp, Homo sapiens
ggtggggcagccagacaccacaattcacaccagcaactatctgatcagagcgatgacgagaaccgcaaagccaaaaccagtgtgccgtggaagcaccggaagtccagggagggccaagtccacccagcatcaccacaccaaagagcagctctttagaatcctgctaaagctcaaaaacatgaaaccacaacgaggatttcttgcgtgcttgctctggacccaggactgttctaagcactcatggatccttccatttgatcctcacaacagccatgtcttcctctgcctctaactgaggctctgctatgtgccatgtccctgacccaccaatgcacctctactatagtcatcttaggagatgattaatgttatccccattagagaaccccagaagaagattttttgtttgttttttgttttgttttggttttttttgagatagagtcttgttctgctgcccaagctggagtggcagtggcatgatctcagcttaatgcaacctctacctcccaggttcaagtgagtctcatgcctcagcctcccaagtagctggaattacaggtatgcctcaccacacccagctaatgtagaattaatttatgttagttttcgttaaagccac

SEQ ID NO: 9722 - DNA, 391 bp, Homo sapiens
cagagcctttgcacatactattctctctgcacagaaggttctgttccctggtaccggttcaccttgttctcagatcaagcatctgccttcctcattaggtcaattttctctaaactcctataacactcacattttgtcttcaacgtacttattgctattatagttttatattatttgcttgtattattaatgttggttaatctttgattaatatgggctctcacctcccactctcaccctgctcatcagtcttggtgcaagaaacagcatagagtctgtctacagcttttagttttgttaattttattttcattttgttatgtttgttcatcagtgcactcagaccatgtctggtacatggctgaaataaaatacatgtcttttgaatgaa

SEQ ID NO: 9723 - DNA, 459 bp, Homo sapiens
gtcctcacctccttttgggggaggggcctggtgggatggaaggtgtctgtggccggctgcccagaacaacaagaagggccctcttcctccttgaacttgagccagcccctggcgtctttctcggggccagagctttgcctctaaatggtctttgtttgcagacgatctgctgtgcagatcatgaaccgtcgccgcagtgccagacagactcttcatccggaccggccgtcccactgggtcccctcaggaaagcgcagaagccggggaccccaaaccgcgtccagctcctcccacccgcccttctcggagccgcgcacttggtaacttgcgtgtgaagaactcacggccgtgttgccaggaaactgcggggagcagcctttgtggtctcacatatgcgtaacataataataaataacggttaacgtgataataaataaacaaataacaataattataacg

SEQ ID NO: 9724 - DNA, 378 bp, Homo sapiens
gaggcagatggatcacctgaggtcaggagtacgagaccagcctggccaacatggtgaaacccagtctctactaaaaatacaaaaaattagccaggcatgctggcactcgcctgtaggcccagctacttgggaggctgaggcaagagaattgcttaaacctgggagcggaggttgcagtgagccaagatcgcgccactgcactccagcctgggtaacagagcgaaactccatctcaaaaataaaaaaacaatttagattatatttttgtttattagtgtcatgctgtcattttacttaaatatttcaaaacctggatctgttggctttatactctcttctttaaagcattcccttaaatatgggatttcttgaccaaaa

SEQ ID NO: 9725 - DNA, 1508 bp, Homo sapiens
gtgcttttggaaaagatcatatgacagctataaagactctgatgaaaggttactagcaggttattcaaaggtactttttttgaaggcaagattttaaggcatgttagggtaggcattcaagtagggtgattttttaaaaatgtatttgcttgccgcagaagacaagtacaggttctgctctgatgcctgtcctggtcctctttcccttttaatgttagaatgtggcaaatgctcagtaatcactgagctagggatttccaaggctcttgtctttgtctgcatcccaggtccagggattgtacagttggtaaactgtaccaaagcatggagaccaggtgtttacgaggattgaagcatagttggtgctcctttcaccaagccttgtaccacaagcctagtgctgtatccatccagagacaagggtgccgttttccttactccaaatttacataagctaccagtgtttgcacccatgctgggctggccccacccagaggagggtgctttttctaactcacaaccaaacatacaggcagaaatggtcctgcctgtgcctacttctctgttagaaaagaaacactcctcttactcacactcatcggattccagttaagccactgtttgcaggggcattccctgaggaaattcgggctggagaagagagatgaaaatatctttctcaattctacctttgtataggaactccattctttgtctatccatagactattggattcccttagcctatatgtgaagaaggatctgatacagagcctaagtcttactgagagccttagaattgtctttagtgaagtgttaaatagtcgctttcaagcattcacttttgtagatgtcttcgcaggatttaaagaaagaataaaacatgccaggatatttatgaatcatgagatttaatagagaccaaagtagatcttattactgatgtgcttactgcttcattaaattccctttaaggtttgcggcttggatatggatcatttgcaataataattaggcagtgatcgattgattgggtctgacattgcacttgtcaccttgaaatgcaaaatccatctattttcaacagtgaacatttctcgctaatcttgcacaccagcatgtgatagtttattttatggagaaagtacaatttataaagtttggagacttaacattaaccttttactaagaatgaagtatcacttgtcattttacaaagaaatgaaaatcatccaaccagcaatttttttgagattagaaaacacagcctaatttcaaaagaatttttcaaatccaaaacgcatgcacttcaattgagtgctacaagtatattgtgagtattggagtttactaaaccttcacatggagtataaatgataaaattgtgagcttgagactagctctgctgtgtgtacagacacacacacacacatttagacacacacacgtctatttgtctatctatttccacatttaattccctaattctatctttgcctcaaaaaaaa

SEQ ID NO: 9726 - DNA, 244 bp, Homo sapiens
atactgatcttgcttcttgtacacaggaaaagcacaaaaagtcaatggtacaaaactgagtttcccagatgttccaagaagactcagttctatgaccctggagaaaaacttcactgtaccctctgggccctagtttccccatatgggataaaagggagcttagactggaatctctgtttaaacagaagagtaattttgagtaggctctttctcaaagtcgattttacaagttttagcacacttt

SEQ ID NO: 9727 - DNA, 454 bp, Homo sapiens
tttagggcagagatgctgtttaaaaatggcagtgactcaatacatcaaatgatgaacagtattttttttcagtgtctaacacagatttctgcttaaaccattttgttggtaaaagtatccagagctctaatgttctacctgcctggttttaataatttaaaaaaaaaactgacatatggttgtgaatgtgtactggatttaaaaagactcatctattttaaaagctagcactgttgctgctaatgatagagtcaatacagtgtgtctgcagcacccagaggtatggagccactcccctcctctccttccacgccggccccacagtgggtcatgctccagggtcgtgccatcattcagacatgtgctccgaaactaccttgatgacttttgttctgatttgtaagatgccccccacccctgccaattcctctcttgttcaaggttaaaaaacaaa

SEQ ID NO: 9728 - DNA, 1436 bp, Homo sapiens
  misc_feature (4)..(4): n is a, c, g, or t
ccanctgtgctacagcctgggcaacagagcaggaccccatctcttaaaaaaatgccacttctcctgttcaatgatgagactcctaatatatgagaggaggccctcctatgtatttcaaatgtggagaggcatatacttctactcagattgaaagatttatcttggaaatccttttttggtttcctttctacataatatgacttcttatttcattccaacttaattccaaaaatatttatccagcacctactgtgaaccagtactgtgctaggccccaggtattacagtagttatcaagacagacatgacctctgcctctaaggagcttagagcctagcaggggaacaggaacttagacaaatttaagtgctgtcccgtagggtactttgaggtcaaatagtagaggcacttcacgtaacataggaggtcaaggaaggctttctacacatttcatttaaatgaagacctaaagggaagcaagaaaaggcagaagagaatgttactggcaaagggaaaagcatgtgctagaagcaagcagagatgagagattaagcttgatgcttttgagaaattaaaagaggttcaagttcgtaatggctacagctgtgagatcaactcttttaagtctcatgacagtacctgtaactaataatattatcccctccatttttatggttgtggcaaatgaggaaaagatgttaaatattttgccctaggtcatccatctctagtaagtggcacagccagggattgaacccaggtcatctggctgtagcatattggctcctaactaccatactggattgcctctcagctggggcatagtcttccttagtaaatggaatggtctgtgtctggtactacctaccataaaaagagctggagcttataggatctggattagtttagaaatacaggtttgctttagtcttttattcttgattgggaatgaaatgcttcatttgatatgcaactctgaggctattgacacatattttccaaaaaaccatagatgggaaattataactggttacatgtttattacaaaaataaaattggtgtgaaatatgtatttcctgcaaggctagggtttttgtttgattgttaaagttaacttggcaatatccttttctctgatttttaaagttaggctgagtgcagtggctcatgcctgtaatcccaaccctttgggcaaccaaggccggaggatcacttgagcccagaagtttaataccagcctggttaagatagtgagatgcttactctacaaaaataaaaaaataagttagctggatgcagtggtgagtttctaagtcctagttataggaggctaaggcaggaggatcccctgagcccagaagttcaaggcagcagtgagctatgattgtgccactgtactccagcctgggtgacaaagcaagaccccatctctcaac

SEQ ID NO: 9729 - DNA, 812 bp, Homo sapiens
ggtcgttgaacattactgataccctctttgatctaaaccctcctttcgtgatcacgcctggtggctcaaagaattgctcccccagcttactgttcctgttggtgctgaaagaatgctcgtaattgttaccaaacagtggacggagcaaggcaacatgtcccctttgcccagctggctcccagttggcacttcattatggcaaagacagagggggtggggtccccgggccttcggcatttcatttgcacccacatgtaggctcacttcttggcctgggaattgatcggtgccagatgctccatctagccagcatccccaccgcagcagggctgcccgcctcctgtttcgtgaaaaacggcccggattttcatcagaccttaattggcctgggtctggccttcattctaccccagcctcttcacagactgctggccactggctgttccctcctccagccaggacaatgccggtccccgggcactgaccctggcccaggcaggcctgccaactccatagctctcatttctcactctgcacatcagtgctggcttcccacacccacagctcctccagaaggaaggtttgtcagcgggcttcaccatgcactctgacataccactgtgtgtctgtccctgcagggccctggaatcccacagttgtttcctgtacccaggcctggggagccagccagtcacatggaccgtgagtgtatccgcctcacgcttctctgtggccctggcttctcccagtggattccgcaaggtgtttcctgcaaatcctgctgatgtctttgctggcacgtagcaaaatcc

SEQ ID NO: 9730 - DNA, 462 bp, Homo sapiens
gtggttactttgcaccaggcactgtgctaagtacctcaaggggagtatctcccttaatgcctgcaacatcctatgagccttgtatgattgcatctcccttttcaagctgaaaagaagttacatgctttgcccgacagtctatagctaggaggagctggagctgagattcaaccccaggttctctggtgcccaagtgctcatgtctttgccctgtgtgcccctctttcacagaaacagagcttcagccaaatcctggaacggaagctcttgggaagctgcctgtgacctttcttattgtgtcccctcagcacaggtcatgcacaggcagctgggaatagatatgcgagttaaaggaattctcgttggaaaacaccagagggatccacagggccacccccccgcccccgcaataccactgtgtgtctgtccctgcagggccctggaatcccacagttgtttcct

SEQ ID NO: 9731 - DNA, 909 bp, Homo sapiens
tatctaaataggcactaatgtgttttttttcctgctactgatgttttttcagaccttacctttctgaattgaaaatatttgataggctaaaatgccacatttattagctggtttatcctgttcttaaaccacaaaagcttactaattctctttttcatccaaacttaccaaagtgatagtgcttctaatagaaatataattgaattgtgccactctttatatatggagataatacaaattggaccctgatctgcaggatgtagcatttagttatatttttagtggtattaaaagcagggtttattagccaggcctggtggcatatgcctgtaatcccagctactcgggaggctgaggcacaagaattgcttgaacccaggaggcagaggtggcagtgagctgagatcattgccactgcacttcagcctgggtgacacagcaagatagcaagatgccatctcaaaaaaaaaaaagaaagaaagaaagaaaaaaaaaggagggtttgccctttagctaactgtctgcaagtgccagtaacctccgcttggtcagagggtcagctccagtttgaggctgcagcctgggacccagaagagcagtatctcagggcagcataaatggtttgcatctatcctagcgggacctcaccgatgctatgtcctaactactgagctacccatccagatttgacgagagatagtcacaaagaagtgtgcatttaccccacggccctgctgttttcccctgtagttctttaaaacatccatgggcattagaaggttctgtgatagctttacttatctaacaaagctggattttttttttcttttcatctgttgttttacaatttggtgactcctgttgtccttatttgatatgatcattaatacaagtttttaaaaacagaaa

SEQ ID NO: 9732 - DNA, 401 bp, Homo sapiens
gaggctttaggctagttaagggttttagggcatggagtggaaggagaggaatgatgaattccctttttgaaatgaagaaacgtaatttaatgagtgcagttaaagagggaggatgatacgttggatgtatttaaaaccatttttggggacgggcacgtggttcacgcctgtaatcccagcactttgggaggccaagacaggcagatcactggagcccaggagtttgagaccagcttgggcaacatggagagactcccatctccacaaaaagtatagaaattagctgggcgtggtggtacacacctgtagtcccagctcctacggaggctgaggtgggaggatctcttgagcctgggaggcagagattgcagtgagctgagattgcaccactgcactccagc

SEQ ID NO: 9733 - DNA, 367 bp, Homo sapiens
gtactctgaaggagcttacacagcatcaggatgattgtccttagttttccatagaaattaatctgttagattgtttaactttgctatagttttggcaatttacatttttctgtaaatatttccttttatccaggttctcaaattattttgcatataagtaagcaaagtaatgtcacgttatgttttaaatgttatcagtttctatggttactttttcattaaaattatttatttgggttgtttctgttttctgtatttagcttgataaggttacctaatgatttatctattttattagttttaaaaaatagaatcagctttgggattcatatattcttcagttctttaattcattttattttgcttt

SEQ ID NO: 9734 - DNA, 486 bp, Homo sapiens
tttttcttgagatgatggagtgtcgctcttgttgcccaggctggagtgcaatggcgtgatcatggctcactgcaacctctgcctcccgtggtcaagcaattctcctgcctcagccaccctagtagctgggattacaggcgcacaccaccacacccagctaattttttgtatttttagtagagacggggtttcaccactttggccaggctggtcttgaactcctgacctcaagtgatccacccacctcagcctcccaaagtgctgggattacaggcgtgagccaccaagcccatcccattaagctacttctaatatgaccactgctgctttgctgctatcaggtttatgggcgctgttccaggtgccagatgctgaactttcgatatgtttcctcacttagttctcacaacaataaaatgaggtaagggttattattattcccatttcacagagaaagcaactgagccttaaagaagtaacttctgc

SEQ ID NO: 9735 - DNA, 383 bp, Homo sapiens
ttgggggggctgcccaggaggaggtgagctcctcattgccggagatgtgcaaactgtgcctggtaggcgtctgctggagaggatgtacgggcacccagatgcccaaagccactcctggccaggcaggacccagagcaaaatgaagtgtgggaatgtccgctccagaattactaagaatttcaacacaatgacaggagagtattaagccaggggcaggacccttctgagttccagggtctgtgtgaccacacaggtccaatgccctccaagccagatcttttggatcggaggaagaagtgtgaggaatgggtctcagggtcatctcaaggtcagtaccatgctaggggcctgaagggatgggccttgtgaagtcaatgggatgg

SEQ ID NO: 9736 - DNA, 472 bp, Homo sapiens
cctgtttccactctttgtttggtgggcaggaaggctcctgctcttcagttggaagtggctgcagctgttattagcagataagcaggagtggcctggccatttctgtgactcacagtgacttagtgggattcatatcaagaattccttccttttctcttgacagttttcaggtacttcagaaggttaggtagaagggatatgagtgattaagatatattttataggaataattgaaagctgggcatttgatgtgttttgattttagaacagagtactggacagcttcacatttggattctgggcaggtatgaattctaatgagagagttaaaaatagtgctaggtaactagtaaagtaagtgacacagagactttcctttagttcttcgtccatctttgtttctcattcgttgacttgcattgcctcatcctttatctactctatcagtgtgaggttatagaataatagagag

SEQ ID NO: 9737 - DNA, 113 bp, Homo sapiens
aaatgctggacaaccttacagctcatctgctgaagagtgtctttatgagttgaggcttcaatgctttcatggagaaattgcctgatttaagtaaatcatgtcactttcaccct

SEQ ID NO: 9738 - DNA, 600 bp, Homo sapiens
agctctaggactttggcatatctgttgttggaggcgtatagtggggggcatgactcagcttctgcttaagtacaagttgtctgcagcgaaggaagaatttgattgtagtatcaacagaaccagacagaactctttgaatataattatatatcttggaaactgactcatcaaagctattagattacatagcatcatttaagcatcattgggctctgtacttttcattatctgtacttttcattatggagtataataggctttatttggtacagaaattgggtctaagatggaaacaacttgtgatttttgaataaacttttggggattagttactttgatgttgtcaagatagcagcatagtaagtcctctgcctttccttttgatttatttataatttagaatcagtttatgattttaaaaaatgtgacagacacagtggcatgcaccagtagtaccagccacatgggaaactgaggcagaaggatcacttgatcccagaagatagagaccaccctgggcaacatagtgagagccccatctcaaaaaaaaaaaaatcaattcccaataccattccagaacacttttaatataaccagatg

SEQ ID NO: 9739 - DNA, 296 bp, Homo sapiens
tttgggtggggacacaaagcctaaccatatcaacatctttgagatcattaactcaagttcccttattttacatcagaagtaaaggaaacttaggaaaggataaattagatgattttctgtgggttgcagtgttgccagagctaactttgtgatacccaggcctgttcaccacactttctacttcaccatattataaatttaggaaaactccataatacatgactcatgttgaagaaacttctggggcggggccaagatggccaactagaaacagcaacgttcggaggctcccatcg

SEQ ID NO: 9740 - DNA, 563 bp, Homo sapiens
gcttttctgcatctggttagacaaggaaatctgcaatttttgacttgcagcatttagaaataagttattttagcaatccacacactcgtggtttattctgaactaacttgagacaaacagctacagatagggaatatcatgagtatttccaagactaaaactcttcacaaagtcagtgggaccctctcatgggagggttttaagacccacaataaaaaaggtggggaaacattgagtggaaagagggcagcaggtcaggggccttccccagaggcctaacacacccaacattaccctggatgaaaacaaatacataccataacatcacactttcttcaatgtgtaacagagaaaatgaaatgtattcaaaggtaagctttcagaattccactttacacaattaataaggttttaatattactctgtgttgatgttaaggaattattaaatatgaacagcattttctggttatatatggaaaataccttgatttatgaggtatgaaaatgctcatttttacgtatgcatgttttacttttgtgctttttttataaaacaaggtg

SEQ ID NO: 9741 - DNA, 231 bp, Homo sapiens
ggctcatctcaaattcctggcctcaactgattcgcttgcctcggagtcccaaaatccttggattacaggtgtgagccattgcgcctggcatctttctcagctttctcctaaacaccaacccttcctcgcctatgccttagacccagagaccatgaactccctgagaaactgccatgcaccatgcactgtgctgtgctaggcactgggatgtggggagaagagacacaatct

SEQ ID NO: 9742 - DNA, 380 bp, Homo sapiens
  misc_feature (250)..(251): n is a, c, g, or t
actccactgcatggatgggatgggtaactgaaatcagcacacccttttgaatggtcatcttcttgcaaaagttccctcaaaaatactcatattggctggatgccgtggctcatctctgtaatcccagggctttgggaggctgaggtgggggggatcacttgaggctaagagtttaagaccagcctggggaacatagcgagaccccatctctacaaaaaattgaaaaattagctagctgtagtaggtgtgnncgcctgtagtcccagctactcgggaggctatagcaggaggattttttgaactcaggagtttgaggttatagtgagctgtgatcgcaccactgcactccagcctgggcaccagagcgagaccctgcctct

SEQ ID NO: 9743 - DNA, 984 bp, Homo sapiens
tctgaaaaagaaaatgatcctctgcgaacaccggaggctttgcctgaagaaaagaagattgaatatagattgttaaaggaagagattgccaaccgtgagaaacagcgtttgattaaatcagatcagctgaagacaagttcatcatccccagcaaactctgatgtggaaattgatggtattggcaggatagcaatggttactaagcaggttacagatgcagaatcaaaactgaaaaaacataggattctcttgatgaaagatgaatctgttttaaagaatttagtgcaacaagaagctaagaagaaagaatctgttagaaatgctgaagcaaagattacaaaacttacagaacagcttcaagcaactgaaaaaattcttaatgttaacagaatgtttttgaagaagcttcaggaacaaattcacagagttcaacagcgtgttacaattaagaaagctttgactctaaaatatggagaagagcttgctcgggcaaaggcagtggccagtaaagaaataggaaaacgtaaactggaacaagatcgctttgggccaaacaaaatgatgagactggacagttctccagtatcaagtccaagaaagcattcagcagaactaattgctatggagaaaagacggttacaaaagctagaatatgaatatgccctgaaaattcaaaaattaaaagaagcccgtgcccttaaagcaaaggaacaacaaaatatctctccagttgtggaagaggaacccgaattttctttacctcaaccctcacttcatgatctgacacaagataaattaaccctggacactgaagaaaatgatgttgatgatgaaattttgtctggttcaagcagagagcgaagaagatcttttttagaatccaattattttactaaacctaaccttaagcacactgatactgctaacaaagaatgcataaacaaacttaataaaaatactgtagaaaaaccagaaaaatttcta

SEQ ID NO: 9744 - DNA, 300 bp, Homo sapiens
tcacagagttcaacagcgtgttacaattaagaaagctttgactctaaaatatggagaagagcttgctcgggcaaaggcagtggccagtaaagaaataggaaaacgtaaactggaacaagatcgctttggggtgagggttttatagaaatattttacttttggaaagcagaaagtttttatgatagttttaagggtaagatgtatatataaagtaactctttgctgtaaattccaagagattaagattaaagctttgtttttaaatgacatccacatttttggatgtctactttattattt

SEQ ID NO: 9745 - DNA, 428 bp, Homo sapiens
atattgcttttgacagtatggtcattgatatggtttggatgtttgtcccctttaaatttcattttgaaatgtaatccccagtgtcggaagtggggcctggtgggaagtgtttgggtcatggggacagatacctcgtgagtggcttggtatcctccttgcagtaacaagtgaattctcactttgaattcacaagatatctggttattttttaaagtatggcatccctgcccccttgctccttctctcaccatgtgattcactggctcaccttcacgttctgctgtgattataagcatccttgaggacctcaccataagacgagcagactccagtactatgcttcatatacagcttccagaacctgagccagtaaacctcttttctttataaattacccagtcttgggtatttctttatagtaatgcaaa

SEQ ID NO: 9746 - DNA, 158 bp, Homo sapiens
ttctgtagatttttgtatttttaaaaaaggtcaagatcttcggcagttttctgaattgaattgtttgtgatatttgctctgtttttaaaatcttctaaggccattaccaggttcagtgcttatcttagtacaatttaaattgattccgtgaataattt

SEQ ID NO: 9747 - DNA, 356 bp, Homo sapiens
tgtggtcagatttattaatgccttattatttatataattctctcaaattgacctttacaattttatttcacaacagatgtctgaagaaatgagtttttattatctttagaggtaatgagtgcctcaagcaatagtgattattagactcataaatgcatgcaaactctaaataaaaatgacccataataagcttttattcagtgtttatgtgtatgctgctctttgaaattcctcagtggtaatctgtttggaatatgtatctactgtaatgtcatggaaattcaacagtggtcatattggggcattgcaagacagtacttgagtgggaccttccccagaatcatttgcaaaaaaaa

SEQ ID NO: 9748 - DNA, 116 bp, Homo sapiens
ttggacactttgtagcttttggtggttagtggagggaaaccttttatgatttaaatacttttactccactgattggttaccatcactgcatgtatcagcccttgatgagtttaaga

SEQ ID NO: 9749 - DNA, 467 bp, Homo sapiens
ttccaaacatcaaagctttgcttctccattccctactgcctgaatttccttttactcttcttggttctttcttctcactcttctttcaagacctagaccctggctcatctgctcaaatgaaacctctgactcttcagtgttgtttgttcctgaatttgggctccagattaagtatgcatgtgtcactacctggggaactagccctttctgctttagtttttttgtttgctctttgacttctcaacttgattgggaactctttgaagacaaggaccatccaccacagggcttggtatttcatggggtactgaattaaaataaaagtttaataaatgaaagagaaatttagttcaattaaataaatctgtattcatttattttttcagtcatttcttcacccatttttttcccaagaaatatacctgtacattgaattcctgctttatgccaatcactctattgtgtac

SEQ ID NO: 9750 - DNA, 1278 bp, Homo sapiens
tcaggagaccgaggtgaaaggatcacttgagcccaggagctggaggctgcagtgagctatgatcgcagcactgcactctagcctgggtgaccgaacaagacctcgtctctttaaaaaaaaaaaaagaattctgggattacaacaggagcccaaggctagaataatgtatcaaaggaaacaggagatctccccgaatctggagaccttcaaaagagagcacttatttacttaggatgagtgaagtggaggcatttaacaactaaggagtctattgtgcaaaaaaccttttccttatctgagcacaaaacaacactgtgggctttagtgaatgtggatcattaggacaccttgcactccccagagtgggtctccccctgcatacactgacatagccccagccaaaacaagcagccttttcactcagcagtggtctgagaactacaccgttaatttcatgtaagcttctgcaaccatcagtacccacagctgagctgctgaccaggaaaacagtggctccttcatcacacagatgcagacactcagtgaatcaaatgaatggaaatgactcctgtccacagagtgccttctcagtcccatattcaaagtaattctgggaactgtgggccatatgtgccactggtacccaggctaagcgcccaccagcattacccttccactccattttggggtacctgaagtggcctatttttatttgttctggacaggctcagtgagactctcatggaaacatggaaacatggaaacatggaaaagatccaaaataaatccttgcctatagctatagcgtctagcactggttctcaaagtaaggtccctggacctgcaacgtcagcatccctagggtacttgttagaaatgcatattctcaggccccaccccaaacctactgactcagaaactctgagggtctagcccagcaattgttttaacaagccctccagatggttctgttgctggctaaagtttaagaactactggcttatagcatgggctataaaccagactgggacattgggttgtaaggaccgtttaattgattcaatccaaataggttaactagagaatcatagctgtctgcagggccaaccacactccagcctgggcgatagagcgagcctttgtctctaaaaaacaaaaaataaaatcaattttaaaatgattgcaggaacccaaattcttacaactctgatttcttgtgagaattagaaaaaaaagcttccctttagacagatgaattagaaaaaggtgccccttctg

SEQ ID NO: 9751 - DNA, 1613 bp, Homo sapiens
agaatttaggtgaattactctattgctctggattgagaaaaacattctaattatgactcaaaatccagaaaccactaaaaaaactggtaattcagactacataaaaattttttaaaactcatgacaaagccatcataagcaaaagacagatgacaaattggaaagaaaatatttgcaactcattactgtcaaagggttcatatccctaacaaataaacaacatatcaacgatatagtagaaaaatggataggaacaaaacaatatgggaaacaaaaggaaatacaaatggctcctaaacatattaaaaggtggtcaaccttaggcatagtaaaaatttacatactgagcagtcaggtgtgtggcgtgcacctataagccaggctattcgggaggttaaggctggaggatcacttgagcccacgagtttgaggctacggtgaactatgatcataccactgcactccagcctgggtgataacgtgggaccctgtctcttttttaaggaaaataaaagaatgtacacattgatataaattttcatctaccagaatggccagaatccaacattttaataacatctacattggtaatgttgcaggttagcaagtactatcataaattttagatggtatgtgaattgatgactacccctatgaaggacaatatgccaatatctttcaaaattataaatgcacacagtctttgcccccaaaattcttatctttgggaatttattctacaggtacaatatttatataaatgtgaaatgacatatgtacaaggtctggaaacaacccagctgcccattaatagaggacgggttaattcaacactggcacattcacataacagaataccaagtatctacttcaaaaaatgagaaaactatctagtcatatgtgaagactgccaagaaatactaggtgaaaaaaatgaagtcgtatgtatatgatgtcaatttttgagtaaaaatgagagaaaaaataagactttccatttgtatatgtttgtacctgtctacaacagtgtgaatggaaacctaagaaaccaagagcacaggctattcatggtgggagatgagtgtgcagtggaggaagctgggccaaggacacaggaacacattcactgaataactttttatattgtttgtttcttttaaccatgtgaatgtattacctattcaaaaaattaaataagataagcatattttataagctttatgattcaatacaaatcaaacaatgcttttaattgttcccactttgtagctgaatggaaataggccaacttacaaaatgtcacaaaggttctagaatcagtctttctcgtctcaaattcttgctccacaacctagaatttgtgactatggacaggttacttagccttttttatcctcagtcttcttacttataaaacagagaagtaattgtacctacctactagtgctattgtgaagattaacggtgtattcttttaaagccaaactatgcatgtaaaagcccttaatacaatgccagccaatgcttgccattatgataagaaacaacctcagactacttataaatacattttctcccttctccacaggttacaatcaaattctcatgccata

SEQ ID NO: 9752 - DNA, 392 bp, Homo sapiens
aaagaggaagtattggatttcgaaggagatgaggcttatttgcatgtgatagaataaggcatatttcttattcctatagggaaatctcaaataggagaattgaacacagcacagatatttttgtctttcacctgcagatctaaccagttattctctaaatttgaagtgccgtaagctagtactgtgtcagtctgtttgaccattagagcagaggtcaaggatgctatgtaatcctactaaagtctatttttacagagagactagtaaaagaagccttgagacctttattgtttacacagcctggaagctgtcactgagtccttaaattgaagcatgacattgtgcagtgatgtgctagtggacaaagaagtacagaacagaatcaaggatgt

SEQ ID NO: 9753 - DNA, 499 bp, Homo sapiens
ctaaatacatcttgtctttccttctttaggatagccccttgaagcagaagttttcttgaatttatcatcatttattaattttacaaatgcataaaatttattagtgaaatctgttgactcatcagcccaggtagagaagctggtatttaacagttaattacacaaaacctcttcagcattatgtatgccatcaatacatcattttatcacactgtttgagagtagaaacttttcaatttctcttactgcattttgctcactgtaaattcacatgctggtattattaggttcttgctactgtcgcttttcatttcattgaaatcttttctctttcatgtgtttacacaagtgcaaaataatattcacagcatcttctaaattttaaccatgaatttaaaactgctttaaagctttggaatagctgggtgcagtggctcacatctataatctcagcactttggtaggctgaggtgggaggattgcttgaggccaggagttg

SEQ ID NO: 9754 - DNA, 475 bp, Homo sapiens
gggcgaaggcgaaatggcccagcctgcggattccgagtccggtctgagcctgctgtgtaaaatcaccttcaagtcgaggccctctttggcccctccggcagcctcgagttccttagcagccaaagcttcgctggggggcggcggaggcggcggcctctttgctgcctcaggtgccatctcttacgccgaggtcctgaagcaagggcccctgcctcctggagccgctcgccccttgggagaggtttctcgaggggcacaggaagccgagggaggtgatggagacggcgaagggtgctctggtcctccctcggcgcctgcgtcccaagcccgggccctaccgccgccaccctacaccaccttcccaggctcgaagcccaaattcgactgggttagcgctcccgacggccctgaacgccacttccgcttcaacggggctggcggaggcatcggggcgccgcgacggcgtgcggccgca

SEQ ID NO: 9755 - DNA, 383 bp, Homo sapiens
ccggagggacctgtacggccagtgccctaggactgtgtcggacctggctttgcagaatgcctttggggaccgctggggaccctacttcgccgagtatgattggtgttccacctgctcctcctcttcagagtctgacaacgagggctatttcctaggagaacccatcccccagccagcgcgcctgcgatacgtcacaagcgatgagctgctgcacaaatacagctcctacggcctccccaaatcttccacattaggtggcagaggacagttgcacagcaggaaaagacagaagagcaaaaactgtatcatttcttaatatgattgggatcagggaatgggagaagatgggagctaagaatgtaaagtcagaaacttgcactgtt

SEQ ID NO: 9756 - DNA, 352 bp, Homo sapiens
tcttcaggatatttggtttctatgataaggtgataaacatggatggcttgatcttggagccaccaaactacattgagctttaaattctccattgggtacaatggttacatgcttcttaccctaaaactctggacttacaagtcatagttgtatgtaagtattaaattcactgaatgagatttttctctagacagatatcctttctgaatctgggtttcctggctgggtgcaatggctcactcctgtacttacaacaatttggaaggcccaggcagaaggattgcttgaagccaagagttcgagaccagcctgggcaggaaagtgagacctcatctctaatttaaaaaaaaaa

SEQ ID NO: 9757 - DNA, 368 bp, Homo sapiens
ttttaattctcatcctactgtctccagcatgactgtacctgtgtttccacactagtgccaactataagaagtcaaaatgcactggccatgccagacaatacaaaccactagtgagcaaagcagagatgcaatttgaggggctaatagtatcagtgatacctttcagcttagatgaaagtaaaaagaaggaaagaaaaaggtaacagtgtgattttcttctcctggcgtcctaaaataaacaattaacttcagcaatatcagtataactaaattaaaaggtctttcatttctcgtctgtttttctcctctaaattcatgttggtttctgcttatcaagtaaactttatcacacaagttaggccttgtat

SEQ ID NO: 9758 - DNA, 609 bp, Homo sapiens
taggctgagaccggtgcgccgcgcgctagtggccgctcttccgcgggctagcgggcggtgggggcgccagcagcgcggaaggcggcacgcgggccatggctccctgggcggaggcgagcactcgcgtctgaacccgctgcgccggttgtggctcacgctgaccgccgccttcctgctgactctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtcct

SEQ ID NO: 9759 - DNA, 436 bp, Homo sapiens
ggtcagagagaagtggtcagcagacatgtggcgcttggggctgcctcatttgggaagtcttcaatgggcccctacctcgggcagcagcctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagccgtgagtgtcct

SEQ ID NO: 9760 - DNA, 462 bp, Homo sapiens
tcttgtttcattaaactcagaaaacccatcatataataagatagaaaatggaaaatgggttttccataagcccaccccaaatattcagtttttccttgaatttaaggtatacttgttttccatcactaaaagtttttctgaacaatattattctaaaaatactggccaggcgcggtagctcacgcctgtaatcccagcactttgggaggctgaggtaagtggatcacgaggtcaggagtttgagaccagcctggccaatatggtgtaaccccatctctactaaaaatacaaaaattagccgggtacaaaaattagctgggtgtggtggcacacgcctgtagtcccagctacttggaaggctgaggcagaagaatcacttgaacccgagaggcagaagttgcactgagccaagatcgtgccactacactccagcctgggcaacagagcaagactccgtctcaa

SEQ ID NO: 9761 - DNA, 614 bp, Homo sapiens
tgaggctgtgcaggatttgccttggttttattagggaacctgctaatagaagcaatttcaagtgacgggcttccctcagtaaaaagctggaagcaatgacatcttttctatctgagtgactctccttagtcgtggtaaataaataaataaataaataaatagatagatagatagataaataaataaataaataaaaattagtttacatgcagtgtttgaaaagaaaatgattttgcttcccaagtttttatgtgttttcttttttaccaactatatttcactttatttacaattgtcagtttattctcacaccttctggttagttttatcttctcaccatggtctgttagaaccccatcctcgagcaaaaaaacaaaaacaaaaaccacccccccaaaacaaacaaacaaacaaacaaaacaggtgttcatccctgtgagatgctaatgcccctggaactgtttgaaaagagcaaaattttgtaaggagattcttttcaaaaagtgttagagaagtattcttcaaaaacatcttagaatgtttccttaaaaaatttcctttcttggttttcattaattgcctttgattaaaattaggttacaaacatatcttaa

SEQ ID NO: 9762 - DNA, 302 bp, Homo sapiens
gcctgagctagggtttcctgactccaactggggacctgctcccagctcttggggctgctctgctcccagcattgaccagctgttgttctgtttagattctaaaccttcagagcccacagacaggatctcctttagggggattcacttctccatagcagtgagcatggtctttgggtgcagctaattcagaggacacttgagcctttgccagtgagacaggcttgggttgtttgcttgtttgtttgttgagacggagtctcactccaatctgggtgacagagtgagactccatctcaaaaaaa

SEQ ID NO: 9763 - DNA, 2044 bp, Homo sapiens
caggccgggcacctccgagcgcaaggacagcgcgaggtccgcgcagcccagcgcagccatagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccaactaaatactaccgtatggcccaccataattacccccatactccttacactattcctcatcacccaactaaaaatattaaacacaaactaccacctacctccctcaccaaagcccat

SEQ ID NO: 9764 - DNA, 4033 bp, Homo sapiens
cggattcacccgcatgtggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9765 - DNA, 3949 bp, Homo sapiens
caggccgggcacctccgagcgcaaggacagcgcgaggtccgcgcagcccagcgcagccatgagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9766 - DNA, 3796 bp, Homo sapiens
caggccgggcacctccgagcgcaaggacagcgcgaggtccgcgcagcccagcgcagccatggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9767 - DNA, 3529 bp, Homo sapiens
cggattcacccgcatgtggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatccctcagagtctacggttcagagtctaagcccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9768 - DNA, 4060 bp, Homo sapiens
cggattcacccgcatgtggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgaggctgcctcatcctacctgttcccccagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9769 - DNA, 4162 bp, Homo sapiens
cggattcacccgcatgtggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggagggtgaggcggtggccctgatcacatagtggcctcttggggtctgaggacatgaggacaagccctccccaacctcgggggctcctcaccctgccaccttgcccacccacccaccatatccccttttttcagtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9770 - DNA, 1871 bp, Homo sapiens
cggattcacccgcatgtggagccccgcgcggactcactctatgatgtccctgtcggtgcggccgcagcgccgtctgctcagcgcccgggtcaataggagccagtccttcgcaggcgtcctcggcagccacgagcgggggcccaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9771 - DNA, 449 bp, Homo sapiens
ccacccttgacctcatcctcactcattacaggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttc

SEQ ID NO: 9772 - DNA, 458 bp, Homo sapiens
gcggccgcgcagggttggtggggtcaaagggcgtcagatggggctgggtctgggggtgcgtagtgagagtctgggggactcctgctctcctctttctgaggacagcctctccttcaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacctgacgtgagcagctcctctgttcccagccctgtcccgggatccctccccaagcccgcatcctgctagcaggaacctttccaggggcagataagggagtccaagaggaattcccgcttggtgagtggcgggaggtacggatgccctttgcctctttggtgtggagggctgggcaagggcagccctggg

SEQ ID NO: 9773 - DNA, 4176 bp, Homo sapiens
gcggccgcgcagggttggtggggtcaaagggcgtcagatggggctgggtctgggggtgcgtagtgagagtctgggggactcctgctctcctctttctgaggacagcctctccttcaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacctgacgtgagcagctcctctgttcccagccctgtcccgggatccctccccaagcccgcatcctgctagcaggaaccttctccagccccatgccctctccctgctgtctgcaccctgggcagcatgaggctggagagccgagttcattcttgtggtcgcccctttcctcagggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9774 - DNA, 3998 bp, Homo sapiens
gggcgctgggagcgatgcccggagcccaggcgggctggctcgaagtggccagtgccggaatggtccgcgtgggtgtgcgagctgcggtgtctgggggcctgtcccggacccaccatgaacaccaagaagagagggagagccccgcgcggactcactctatgatgtccctgtcggtgcggccgcagcgccgtctgctcagcgcccgggtcaataggagccagtccttcgcaggcgtcctcggcagccacgagcgggggcccagggcctacttggaagtgcaccagcaggagcaagagaaactccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9775 - DNA, 4046 bp, Homo sapiens
gcggccgcgcagggttggtggggtcaaagggcgtcagatggggctgggtctgggggtgcgtagtgagagtctgggggactcctgctctcctctttctgaggacagcctctccttcaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacctgacgtgagcagctcctctgttcccagccctgtcccgggatccctccccaagcccgcatcctgctagcaggaacctttccaggggcagataagggagtccaagaggaattcccgcttgggcttcctgtatgatctggacaagcaagtcaagtccattgaacgcttcctgcgacgactggagttccatgccagcaagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9776 - DNA, 4064 bp, Homo sapiens
gcggccgcgcagggttggtggggtcaaagggcgtcagatggggctgggtctgggggtgcgtagtgagagtctgggggactcctgctctcctctttctgaggacagcctctccttcaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacctgctccaggagcttccagtggggtaggtgggacccctacagacatggacagcaggagattctgctgcagtggtactgagcagtggtactgctgcatggtgcttcttgggaagaggttagggcttcctggaggagggaacacttctgccggggcttgatgggagttcccctgcagagggaaccttgcacaaggaagcagagctctccccagtcggatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggagagcatgtgtctgctggagagcgagctggaggcacagctgggcgagtttcatctccgaatgaaagggctggctggcttcgccaggctgtgtgtaggcgatcagtatgagatctgcatgaaatatgggcgtcagcgctggaaactacggggccgaattgagggtagtggaaagcaggtgtgggacagtgaagaaaccatctttctccctctactcacggaatttctgtctattaaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggagccccttcgacaaggatgaccagccctcagctgcttcttctgtcaacaaggcctccacagtcaccaagcgcttctccacctatagccagagcccaccggacacaccctcacttcgggaacaggctttctataacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatgcagagacaaggtctgactcgcagccgggcctccagtctcagcatcactgtggagcatgccttggagagcttcagcttcctcaatgaagacgaagatgaagacaatgatgttcctggggacaggcctccaagcagcccggaggctggggctgaggacagcatagactcacccagtgcccgccccctcagcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9777 - DNA, 1360 bp, Homo sapiens
gctagtagggctggtgttgaatcggcacgagggcacggggtgtccagctctggatgctgccttggtccggcacctgtaccactgcagtcgcctcctgctgaaactgggcacatttgggcccctgcgctgccaggaggcatgggccctggagcggctgctgcgggaagcccgagtactggaggcagtatgcgagttcagcaggcggtgggagatcccggccagctctgcccaggaagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctgtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggaggtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggccctcctgtgcttcctggaccagctggaggatgaggacgtgcagactcgagtggctggctgcctggccctaggctgcatcaaggctcccgagggcattgagcccctggtgtacctctgccaaactgacacagaagctgtgagggaagctgcccggcaaagcctacagcagtgtggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcctacaaaaaaagg

SEQ ID NO: 9778 - DNA, 313 bp, Homo sapiens
aggtggggggctggagggagtatgctgaagaaccccaatatggctcaccgacttctccccttctcctccaactcagggctggctggcttcgccaggctgtgtgtaggcgatcagtatgaggtatgagaatgtgcagggaagggctgggtcggtagggtcccaacacctaggctgcctcatcctacctgttcccccagatctgcatgaaatatgggcgtcagcgctggaaactacggggccgaattgagggtagtggaaagcaggtgtgggacagtgaagaaaccatctttctccctctactcacggaatttct

SEQ ID NO: 9779 - DNA, 1442 bp, Homo sapiens
cagcacccctgcctcattaaccagatggctgggataagactcttgattttgaaaattcaacaaccagagttcagctatttgcagtgatatgcagtcatttgtcactatcaaaaaggaaaataactaaaatgtggtgtgttggcattagttacttactaatgagcaagatcagcacctgcatttcagcttggctctgtcattttctatttattggaagaatggtgttgtggttaagtgtgtggtgtgtagaggaagactatttgtttttttgtcttgttttgtttttattgaaatatagcatgcatactgaaaaatgcacaaatcatatgtgcagagctcactgaatttcacagaatgaatacacccatgcaatagcactcagatcaagagacagaacattagcagcacccccagaaggaccacccccaggatcccttccagtaaccacaccccctccagtagaaactattatccttacttctaacatcacagattacttttgcttggttttgtaacttatataaatgaaatcacaccatatctactcttcgtgattattttcactcaacattatgtttgtgatatccattcgtattgttacaatagttgttgttggttaactctcattgctgtatagtattacattgtgtaaatataccaaaatttatttattcaattcattgtactattcatggttattagtttgcaattattggcaattatgaataatgctgctataaccatttctttatattctttgtagtgaacatgcatgtatttctgttgttatatatttaggaatgaaactgctgtgtcattttgtgtgcatatattcaaatataatagttgttgccaaacactttttcaaagtggttgtaccactttgcatttccaccagcagtgtatgagtgttctagttgctctaaattctcaccaacacttggcattttggtattttttattttagccaatgtggtgatcatgtggtgacctctcattatggtttccttttgcatttctctgatgactaatgaaattgagaatcttttcaatatatgttcgactggccattgtacatcttgttttgtttgtcttttagatgtcttttgtcattgatttgtaagggctctttatgtattctggatatgaatcttttgtcaaatatatgcattgcaaatatatacttttttacttattgatatctttaatttgttttaagaaaatttttaatttttatggaaattttatagaaatgctgaaaatcaaacgttatctgcagtggtaacagtctgacttctaaactgctatatgtaatagaagaacaatacataattgttgtatatatttatgaggtacatgtaatattttgatacaagcataaaatatgtaatgattgttgatctcttttaatgaacagaattccttaatcataaaaaaaaaaa

SEQ ID NO: 9780 - DNA, 754 bp, Homo sapiens
cagctgaaggtcaagcgaaggctttaaaggcaagaaggcagtgttgaaaggtgtcacagccacaaaaagaagaagatccgcacgtcacccaccttccggcggccgaagacactgcgactccggagacagcccaaacatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatggagagaagaaggcatatgttcgactggccattgtacatcttgttttgtttgtcttttagatgtcttttgtcattgatttgtaagggctctttatgtattctggatatgaatcttttgtcaaatatatgcattgcaaatatatacttttttacttattgatatctttaatttgttttaagaaaatttttaatttttatggaaattttatagaaatgctgaaaatcaaacgttatctgcagtggtaacagtctgacttctaaactgctatatgtaatagaagaacaatacataattgttgtatatatttatgaggtacatgtaatattttgatacaagcataaaatatgtaatgattgttgatctcttttaatgaacagaattccttaatcataaaaaaaaaaa

SEQ ID NO: 9781 - DNA, 279 bp, Homo sapiens
ttctgagctcatgggacatcatgaatgtggtatgcaaatgaggtggcaaggagcacgtagctcctttgctcacatgcgtgcatcatggtcccgttggacttcacttgaaaacacaggttcgaagataaaatgattaagaatttcaagacagtgccatcagagtattaaaccaagcttcaggcccttctgagggcaaggctctatgcacatcacatgcccctgaagctgaccctgcttgcctgattctctgacatgaagaaagaaattccactgtgcttt

SEQ ID NO: 9782 - DNA, 107 bp, Homo sapiens
taaactaacaccccaaactatctaatttgattagttttcacgtttagtaacatcagtaaagttctcttcaaattaaaatacgcagacaagaaactaaaaaaaaaaaa

SEQ ID NO: 9783 - DNA, 2814 bp, Homo sapiens
gaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataacgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgcccgcagtaaagatagtttggggattttaaaagttttctctattacccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattgggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgcctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccacaaaaaa

SEQ ID NO: 9784 - DNA, 2748 bp, Homo sapiens
gaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataacgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattgggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgcctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccacaaaaaa

SEQ ID NO: 9785 - DNA, 2760 bp, Homo sapiens
gaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataacgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgcccgcagtaaagatagtttggggattttaaaagttttctctattacccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattgggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgcctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccacaaaaaa

SEQ ID NO: 9786 - DNA, 2793 bp, Homo sapiens
gaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataacgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgcccgcagtaaagatagtttggggattttaaaagttttctctattacccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattgggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgcctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgtggctaaagtattttattaaattaagtatgtaatttgcaaatggcttcataagaaaatttacaagcaaatttataaaacattttcaatttgtc

SEQ ID NO: 9787 - DNA, 409 bp, Homo sapiens
gaaaatcaatgaaactagaaatcgattctttaaaaagatcaataaattgacaaacctttagctagagggactaagcaaaagagggagaagagtcaaattactaagatcagaaatgaaagcaagggcattattagtgactctacagaaataaaaaggattataagagagtgctatgaacgattacatgccaacaaattggataacctggatgaaactgataaatttttacaaacacaaaacctatcacagctaaatcacaaagaaatagaaaatctgaataaacctataactagcaaggagattgaatgagtaataaaaagtctcctgagaaatgaaagctctggaactgatgcactgctgaattctacccaacatttaaagaactaacaccaatccttctcaaacctaa

SEQ ID NO: 9788 - DNA, 472 bp, Homo sapiens
aatcttagcaagtcgacctgtaagtctgtttataaaacaggaatgacttatacatcagagtggttgtgaaaattaagggaaagattttactgttactggaccataggcatttcccatcctgcttcttttaagttattcatgaaaaaaattaaaaactatgttctttgatactttaccctaactaaccttttttttttttcccatcttaggtttcccaaaccactccttatgatccagtgaatattcaagagagctacatttgaagcctgtacaaaagcttatccctgtaacacatgtgccataatatacaaacttctaccttcgtcagtccttaacatctacctctctgaattttcatgaatttctatttcacaagggtaattgttttatatacactggcagcagcatacaataaaacttagtatgaaactttaaaaaaaaagtcgacgcggccgcgaatttagtagtagta

SEQ ID NO: 9789 - DNA, 444 bp, Homo sapiens
  misc_feature (349)..(349): n is a, c, g, or t
  misc_feature (352)..(352): n is a, c, g, or t
  misc_feature (359)..(359): n is a, c, g, or t
  misc_feature (440)..(440): n is a, c, g, or t
ggagccagcactaagattcccttctggagaccttattctccacaattcctagcctcagtgctcctctcctttgcttctcctcctatgaatacccctcctgactactcactcctccaacacagtttattttcatacttaattttagcagaccagaaaaaaataaagtttcagtctcaagccacaaatctcctttgctgtccttaagtgaggcatccaacagcgctattctatagtataggatcagtggaatgggataaactgtgggagtcttatatggaccctataaggggcaaattaattcaccaatttggcattacattggaaatggaacaggattccaggtccattnttnttagggntacggttgttggggggccatttttttggaagggcaccccaacgggctttgtggcttggtggggggtttttttttccccttnccaa

SEQ ID NO: 9790 - DNA, 365 bp, Homo sapiens
cggccgcttactactactaggttcgcggcccgtcgacctcagcctcccaagtagctggggcaggaggatcacttgaacctcaggaggcggaggttgcagtgagctgagatttccacactgcactccagcctgggtgacagagtgagactccatctcaaacaaacaaacaaacaaaaaaaacccattattctgaggagtccatgacacaaaaaagttaaagtgatctaggaaatcattgaaaatgaaataagaccaaagtgtgatgatataacccccttgaaatttaacttatctttccctctttctgtcatgctaagaagagatcataggccgtcgacgcggccgcgaatttagtagtagtagta

SEQ ID NO: 9791 - DNA, 367 bp, Homo sapiens
tcctgccaagatttttatagatagttgattctcatattatattgaaaatctttgccaaatatgttttgtgttttcttcggtgaccttggctaatacacttcttgacccattgtaatggatccgcttcttgctcaacacttacaaaaatgtgacctaccaagctatttcactaaataaatggcttctggttttagggggaattttgtcattctcctgtgagaaggtgctaaaggtagttatttttttaaatagcatgtttttttctgtatatttttctatatattcaattacctactgagcatctccacttgtttttatatacacacttcaaattcattatggacagtattcaacttatctttccctt

SEQ ID NO: 9792 - DNA, 391 bp, Homo sapiens
gaaacaaatgatcaccttatgggttattttcatcttgctggtgtccccttaataaggacaaagagttaatactttgcttgaaaaactgaatgggactgggcggggtggctcacgcctgtaatcccagaactttgggaggccaaggctggtagatcacttgaggtcaggagatcgagagcagcccctgcccctgggggatggtgaaaccccgtccctactaaaaatacaaaaattagcctgatgtgctggtgggaccctgtaatcccagctattcgggaggctgaggcaggagaatcacttgaccccaggaggcataggttgcagtgagccgagatcgtgtcagtgcattccagcctgggcaacagaggggactccgtctcaaaaaaaaaaa

SEQ ID NO: 9793 - DNA, 485 bp, Homo sapiens
ctgcttcccctcaccttatgccatgattgtagtttcttgaggcctccccatccatgcctcctgtacagctggtagaactgtgagtcaattaaacctcttttctccataaatttccccagtctcgggtatttctttatagcagtgtgagaatggaataatacacctttgggatactagacctaaaaatacttattcatcattttatttgatttacctgcaaatttcaacaatgttaactattccttcctcaaagtatcttcttcacatgccttatgtaatgtatcatcaccctctagtttttctccctttcttgatatctaattcaaaattatttccttctaccaagttaccaaaagattgatttcccaatatttgtcttagtgcttttctcatctcactctacagtttccatcaaactgttatcatctatatatattatctatgtcaaggtttctatcaatatctatatccagataactcacaat

SEQ ID NO: 9794 - DNA, 476 bp, Homo sapiens
ctagagaatataattaaacatgctaacatgttgctgtaatttcctaattctagctagtgttcttattttaataagcataagtgtgccttagtgcgagaagtcctggaaatggacttcacatcttgaacttaggatatttacatgtaactactagttgtaccagttacatgtggcttcagttgctaaactggggttctacagaagtcactaaatttttcccccttatcctcagttcagtttgctctaaagtgggaataaaaatatctccagttggtacttaagagaactaaatgaagtatgaaagtgcctttggtaagctagaaagcattatacagatgtcatccacttttaaaagggggttaagccattttcttaaatgagaatttttccagaaagggatatttttgccaaatttcagtttcttatacaaggcttcgctagtgttacatgtgcatttcttcccttaaatctttaaa

SEQ ID NO: 9795 - DNA, 547 bp, Homo sapiens
ttaaactcttaaaatttcattaaaaattgaggcttatttaaccttgatttctcattccccacccacttcaacttcattgtcttttaatagtggtttaaattttttttgaaaatcagtggagaaattatcatcaattggtaatgtacttttgtaagttctttctcatgactagaagcttacttcactgcaaaggtctttggttcttttctgtttatattagtgtcattttcacacttttatagaatgcagttagttggtttcactagtaatatttttcgttaagtatttgtttccactgggatcccttgtccttttcatcagtctgaatctcaagtttgcagtaagagaaggaagaccaaagaaaccaggccccttagttcaaaaggctggagagaacgttttctattactgtttccttcatccagggagaatagcacccagctgaactgtggttgggagcacacagacccacttctctacctcagtgcattatggcctctggggcaagttcagccagtgtctataggcagataaatggagcaagatt

SEQ ID NO: 9796 - DNA, 453 bp, Homo sapiens
tagctatgaatttaaatatttgattactttttgatatgccatttctaaattacctctaaaattaagaccaaaataataaatacacataatactaatgtttcagaaatgagctccaccattacttacagtgtgatcatacaaactaacaccttgtaataattagtcaccttttgtcaatatttatttgaatagccaacaacagcatagaggatgtgcattgactgctaagcctagaatgctagaaaaataaggaaaggctgcgcttcctttcctcggcgtgatctgtccacctgctatctgtggggaacttggctgctgagcgaatcgctctgttctatgtatagctttgttgatttacatagttctccaaaaggcacacacccagggttttgtttcaagtgaataatgttaacagacaaactgtctaataaacctgaaatgttctcccagggg

SEQ ID NO: 9797 - DNA, 607 bp, Homo sapiens
atttctaatggaacataggctagatgatgcagagagaggaattacaaagaaaccctcctgcacccacccccaagaatcagtgataacttttgtaaaactacggtattatagagaagtaggctgtgaatgtcaagtagaaagtgcagaagctttttccaatcactttactctaatattgccaaccaagacttgctctaaaaccataatacttgtgaagtctacaactgcatttaaattaggacatcttaaagaacaagccccaaaactggctacaagaacgtctttcctgccaggctttagtatacaaagccaacaaatgcctgctagagatacctagtagtgtgaaaatgttagcagcattgtaaacttcaatcctggcagcttagttttttttactcttatttgttgtgatttgaatttaataatacattttcttcagaaagcttaaatcctgtgtgttaaatttgttacagaaatggaaaaaaaaaaaaccttttgttaacatttttcttttctctctttccataaaccctccccctactccatttacatgcagaacactcatccagtctagtgtctaatatatctaggtggttgaaatccaagt

SEQ ID NO: 9798 - DNA, 1083 bp, Homo sapiens
gctaaagcctaaaagcaaaccctgacaaattcacaaaggggtggattggtgattgagtcctgccaaattagagggtcttgggaaatgctgtgggctttccatgaatccgttgtaataaaacataaaccagtccacataagtccaaagtgatcagacagtaattttactgcccactagaacaagattaattcacacaatcaatgacacatgttagccaggtcgatatttaagcaaaatacatctaagaacagctaacaaataactcttctcaaactcacatagagcattcagcaagatagaccacatgtgctgagccatcgttagtattttctgtcctttctctttgactcgtgtatagtgtgctcaaactcttaaaattatacactttaatgattatacactttcatgcatctcaattgcatgtaagttatatttcaatatatttgttaaaagtttataattaaaaaaactgtcctagcttgattcaagaaatcttttttatatttaagaaaatgtaatgttatgtattatcagggcaaaagagaaaaaccatatgattaccttgtcatacacagtaaaagcatttggcacaattgaaaacttttttcatgatttataaaaacaaaccccagaaaactctcagcatgataagaagagaaggcaacactttcaaccctattaagggtagatttgaaaaaaactcagaggtaacattatattaaatggcataggattgaatgcttttctattaaatcagagaaaaaagtagaatatctgttgttattctttcaattcagcattatactagagatctaaatcaatgcaataaagtaagaaaaataaataaaagtattgaaaagattgaaaagaaagaattgaagctgtctttattcacagataatgactgtgtatgttaataatcctagaaatctacaaaaatctgccaaaactaattagtgagtttggtaatgttgcagaatataagctcaatagaagtagtcttttgtatttctgtgtattagcaatgagcatttggaaaatgaaataaaaatacaatttcatttcaagtaacatctaaataca

SEQ ID NO: 9799 - DNA, 366 bp, Homo sapiens
gatgccatggcttcttccttgctcttttgcttggattatttctgagggaagccagctgccaagacactaaattgtgaggacattcagtcagccctctagatggggactgaggcctctaccaagagccatgtgggtgagccatccgagaaccacccttcagacccaggcaagccttcagatgactacagccatgactgacgtcttgactacaacctcatgagagtccctgagccaaaactgctcagctgagctgtttctgacttacagaaactatgagatgataagtgtttaacttttttttttccctgagatggagtctcattctgtcccccaggctggagtgcagtggtgcaatctcagctcact

SEQ ID NO: 9800 - DNA, 358 bp, Homo sapiens
taaagttagcacaaactccgaatgagtgaatcctaaagcgttgctcctggaggaaatacaggctgctggtcacaatatttttatcaactgatcaatatataccttgtcttatgtgtgtttctgcttcaagacactttatttaatatatacgttgattcattaactctgaactctctaggcaacagcattataactcctgccttcacaaagcttatctaacacacacatttcctcctcaggcacatcccagccttcttgcacttaggattcagcagtatgcttaagggccattttcaacagcaaactcatcagcgcaaacacaaacatgtgaaaaacgtagcactaaagagactgcaaa

SEQ ID NO: 9801 - DNA, 2793 bp, Homo sapiens
aggtaacagtattgactcactcaaagccttcgttaattgactacaggaagccttctgcattgaaatttgaggtggtccatatgccacaggacagaacagaagaaaatgaaatatttgttgacctagctctgaatgtcttgccaggcttatcaacctggcaatcagttataaaattaaatgatttttttgttgaaataagaggaactttaaaaatgatgtgtgagagctttatctacaatcagacgcttatgaagaagctacaggaaaccaactacgatgtaatgcttatagaccctgtgattccctgtggagacctgatggctgagttgcttgcagtcccttttgtgctcacacttagaatttctgtaggaggcaatatggagcgaagctgtgggaaacttccagctccactttcctatgtacctgtgcctatgacaggactaacagacagaatgacctttctggaaagagtaaaaaattcaatgctttcagttttgttccacttctggattcaggattacgactatcatttttgggaagagttttatagtaaggcattaggaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagcttttatcactcatggtggaatgaatgggatctatgaagctatttaccatggggtccctatggtgggagttcccatatttggtgatcagcttgataacatagctcacatgaaggccaaaggagcagctgtagaaataaacttcaaaactatgacaagcgaagatttactgagggctttgagaacagtcattaccgattcctcttataaagagaatgctatgagattatcaagaattcaccatgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctggcctgtgtggcaactgctatattcttgttcacaaaatgttttttattttcctgtcaaaaatttaataaaactagaaagatagaaaagagggaatagatctttccaaattcaagaaagacctgatggggtaatcctgttaattccagccacatagaatttggtgaaaaccttgctattttcatattatctattctgttattttatcttagctatatagcctagaattccacgatcatgaggttgtgagtatatctcattctttcgttgtattttcctaggtgtctttactctcttctctcactttgtgacacaaggacatgaatacatctaaattttcctatttctgatatgactgttttgatgatgtcattacttctataaccttaagtgatagggtgacatgcaatatgattattcctggtgtgcgcccaaacacatggatataaagaggtaaaaaacttaaaattcacaaaattcagtaaaccacacaaatcaggtaagtgttctatgagattagctggctatgagaaacataatgatgtttctttttcaatttaaataagcccttctacatagccagcatcagtgatctcagaaaataaattgctaataatgatgacatggcattatgcttagaaaagtttgctgtatttccatagacctcatctagatgtcatggcctacatttctgccatcactcaaccaatacttttttctgttttcttgatgataaaaagacctttctcatgattgccatcaaataacaaaagaaactattttttttctcacatagagaacatgtcagtaagatattcaaggtgaacagattatttttgggattagtaactatttgaaatatgtggtgataattactgagtttataaaatttatttgatagtacacttaaagaagatttatatgtttattctttaaaaatgatgaatactcataattcttatctctataatcaaaagtataatttactgtagaaaaataaagagatgcttgttctgaaagtaagatcagtgaactgcttttcagtctcaatctttgagaattgtaaattcatcaaataattgcttacatagtaaaaatttaaggtattagaaaacctgcataacaaatagtattatatattaaatattttgatatgtaaagctctacacaaagctaaatatagtgtaataatgtttacactaataagcaaatatgttaatcttctcatttttttactgtcatataatcttagtgatatgcctattaatagttttaaataaataaattggcttatctggctttttgaaaattttgaaattcttacagatgttgattaggtatatctacaaattaatttcaattttaaaatgatgatataaaaataaatataagtatttttcttgtgtatgtatacaataaatataaataaaattgtttactgttttgaaagtttaaaaagttt

SEQ ID NO: 9802 - DNA, 2890 bp, Homo sapiens
aggtaacagtattgactcactcaaagccttcgttaattgactacaggaagccttctgcattgaaatttgaggtggtccatatgccacaggacagaacagaagaaaatgaaatatttgttgacctagctctgaatgtcttgccaggcttatcaacctggcaatcagttataaaattaaatgatttttttgttgaaataagaggaactttaaaaatgatgtgtgagagctttatctacaatcagacgcttatgaagaagctacaggaaaccaactacgatgtaatgcttatagaccctgtgattccctgtggagacctgatggctgagttgcttgcagtcccttttgtgctcacacttagaatttctgtaggaggcaatatggagcgaagctgtgggaaacttccagctccactttcctatgtacctgtgcctatgacaggactaacagacagaatgacctttctggaaagagtaaaaaattcaatgctttcagttttgttccacttctggattcaggattacgactatcatttttgggaagagttttatagtaaggcattaggaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaagttataccagaaaaccaagctctcttaagccatggcatctgtatctaaaatagaaatacagaaggagagctgacaatttccatcattctctaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagcttttatcactcatggtggaatgaatgggatctatgaagctatttaccatggggtccctatggtgggagttcccatatttggtgatcagcttgataacatagctcacatgaaggccaaaggagcagctgtagaaataaacttcaaaactatgacaagcgaagatttactgagggctttgagaacagtcattaccgattcctcttataaagagaatgctatgagattatcaagaattcaccatgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctggcctgtgtggcaactgctatattcttgttcacaaaatgttttttattttcctgtcaaaaatttaataaaactagaaagatagaaaagagggaatagatctttccaaattcaagaaagacctgatggggtaatcctgttaattccagccacatagaatttggtgaaaaccttgctattttcatattatctattctgttattttatcttagctatatagcctagaattccacgatcatgaggttgtgagtatatctcattctttcgttgtattttcctaggtgtctttactctcttctctcactttgtgacacaaggacatgaatacatctaaattttcctatttctgatatgactgttttgatgatgtcattacttctataaccttaagtgatagggtgacatgcaatatgattattcctggtgtgcgcccaaacacatggatataaagaggtaaaaaacttaaaattcacaaaattcagtaaaccacacaaatcaggtaagtgttctatgagattagctggctatgagaaacataatgatgtttctttttcaatttaaataagcccttctacatagccagcatcagtgatctcagaaaataaattgctaataatgatgacatggcattatgcttagaaaagtttgctgtatttccatagacctcatctagatgtcatggcctacatttctgccatcactcaaccaatacttttttctgttttcttgatgataaaaagacctttctcatgattgccatcaaataacaaaagaaactattttttttctcacatagagaacatgtcagtaagatattcaaggtgaacagattatttttgggattagtaactatttgaaatatgtggtgataattactgagtttataaaatttatttgatagtacacttaaagaagatttatatgtttattctttaaaaatgatgaatactcataattcttatctctataatcaaaagtataatttactgtagaaaaataaagagatgcttgttctgaaagtaagatcagtgaactgcttttcagtctcaatctttgagaattgtaaattcatcaaataattgcttacatagtaaaaatttaaggtattagaaaacctgcataacaaatagtattatatattaaatattttgatatgtaaagctctacacaaagctaaatatagtgtaataatgtttacactaataagcaaatatgttaatcttctcatttttttactgtcatataatcttagtgatatgcctattaatagttttaaataaataaattggcttatctggctttttgaaaattttgaaattcttacagatgttgattaggtatatctacaaattaatttcaattttaaaatgatgatataaaaataaatataagtatttttcttgtgtatgtatacaataaatataaataaaattgtttactgttttgaaagtttaaaaagttt

SEQ ID NO: 9803 - DNA, 423 bp, Homo sapiens
ccagtgacatttcatacaatggaagctgaggcagcctgggcccctaactaaggacaaaatggttcaagggccccaccaacctaggatgaacatgaagtatcgataaggataaactgttactgttttaattccctgagattttgagattattaacacagcccaacatgtcacaccatggcacatgtatactgtaaaatacaatgtagtcactacaaataataaacttgctgtgaatatacacatgagaaggggtgtcactgatatttgaccaagctaagaaggcaagctgtaggccgggcacggtggctcacgcctgtaatcccagcactttgggaggccgcggtgggtggatcacaaggtcaggagattgagaccatcctgactaacacagtgaaaccctgtctctactaaaaaacacaaaaa

SEQ ID NO: 9804 - DNA, 309 bp, Homo sapiens
gtttccctgttgctcaaacccctaggaggagcatgcagacgggcaggtgcagaggccgtggggagcgcttctgggctctgacctcacggcagcgtctagggatggctgtctgtgactcccgaatccctagtgggcgtctcttacagtgtgctctttcagctttgccgtctgcagaaggattatgttaatcagctcgatagaccctctgccttattgcaagggcagtggccagtttaacagctttctgtatcccaagttcttgcccagtgtacaagaagaatcggatgacacgtgggcttgaaggatgag

SEQ ID NO: 9805 - DNA, 369 bp, Homo sapiens
tacccttatcttatttgttatttttttttctgggttctccatttcttgtcactgccctgagccctgggtttgtcttagcagtttggactatctacaggttaagatcagaggtgccttttctctgtgagtacgagtggggctgcagtagaagcgggggagagcttgcggaaccccaagctctctgcttcatgctactgcatttttctttactaggttctgttgagtcgggaagcagatcaaggtcaagttagtcctcacccttcctaacgcgttttctaaggttcttctgcatacttaaaaaagttcgggacctaagtagttaccgggaccccaagagctacgaggtttaggcctgccttcttcaaggcg

SEQ ID NO: 9806 - DNA, 433 bp, Homo sapiens
ctattttaaaaatatatatatgtatagtagctgtccaggcgttaccatggtaggagataagttgcaggcagaaatcagtgaatatggtggtcattgtgccagtcattacatcactttataaagcgatgttggtaactgagctgcaatagaaatttcgggagagaataagaaatatgaaagactgtactacagattctaggaaaggtaagaggaaaggagcctcttcatcatgttttgtagaataaatgttaccattgttcatttaaaacctaggatagagaaatcatgtgccagatgtcataatctgtatggttctttcctgtggattactgataaaaatgttatggggaatgcatttggggcaggagtaagttaatgaaaagaatttgggaatactgaacttggtataaaaaatatgtattatagatgtctc

SEQ ID NO: 9807 - DNA, 330 bp, Homo sapiens
aatagctttatcatgaggttgctccctcaaaggtgcttctctgaatagcctgtttcacatattagttgcattgccctgcatttgacacttaactcgttgtaccttttgtcatcaatgaaatgggatacaattttcttaacagcctccttttaaatataaggagactgaggcccaagacagttgaggaactggtccgggctcctacagcaaattgtaaggcagggatttaaaccaaggtaatgtggtctcagaattcctgtcttaacagttctgctgagctacccatctggcatttcttcacgtgcctggtccctggaggcttggccctta

SEQ ID NO: 9808 - DNA, 162 bp, Homo sapiens
atctgaataatatccctttttattcaactgattagtaactttaatgccatctgcaaaaatttcgtttgccatataacattatcttagtccattttgtgttgttataacagaatacctaaagctgggcaattcataaagaaaagaggtttaattggcttatga

SEQ ID NO: 9809 - DNA, 420 bp, Homo sapiens
ggatgaatttttagattatttcatctttggctatataaacaaggccttcagtgaatagccctgaatttatttatttgtatatgtgtgggtatcctatagaataaattttccaaaaaatattttgcctgactgaaatttgaaatttgacagctactgcccaaattgtcccctaaagtgcatgcacccaattgatccttcccacaaaaggcataagagaatgcctgttttcctgcatccttcccaaccctgcaatattataggattgtaggccctctgtgtccaatcatttgtcctgtgcacagagcaaataggaataatgactggtaaaaaacccttaacctcacaaagcataagggacacagacataaaaacagaaattatagtgcaatgtgggaagtgttctgctaggaaaaaaaaaaa

SEQ ID NO: 9810 - DNA, 358 bp, Homo sapiens
ttaagtgtgcgatttattctagtaaggctggattgggagacccagaggctgagatgagtctgtttccaatctctttccctccaatgtaggccttgactgatgcagccagtcatttgaaggcatggggcctaccttccactcctttgtgagctatcaggagactagttctgtcatcagagaaagggagcatctactccagccctcccaggctagaacacaggaaaagggggagagttcccttacatcatcctaataaaggttagtccaattctggattgccctctgacattagcacactagcaacatgtgaggtttcgccattagccttgcatgtttgtgtccacttttattgattttt

SEQ ID NO: 9811 - DNA, 431 bp, Homo sapiens
cccgaaatttgcctggggaaagcaagtgctttttcccccggagtgagaaggatgggggggcggaggggttgtgttgccgagcagcgcttagagagagatccccctccagggacacccgcctcgcccgtgatctcggtctctcctcgtagcagctgggcgcggtacagtgaggaacttcacgcgcctcagcaggacacggtaagaagcctgtaacacaccagacaccgagcctctaacgcagggcgcaggcacagcgcgcacagcctggggtcccgcgcttggtcgccgaccatgtcactccagaagggagacaaacttgcaggcttcagacaagacgggctcaaagtagttggagctgcctacgccgcgtcccgagaacagtgggtgcctccgaggctcgggcgcttccaagtgaacacaccaaggggagg

SEQ ID NO: 9812 - DNA, 674 bp, Homo sapiens
atttcagataaacagatgatttaagtatgttccatgcatactaaggacatcctgcatttttatttgctaaatctggcaaccctctagaatctagtcttctaggtcattctagtccaaccttcaagttaacagatcgggagaacttgagacatgttaaatgtacttctcacagccagtcactgccaacatcaggattccaacctggtctgcctgactccacgttgtgtgcctggtatcccactaggagccccaaactgtcacctgctggatgggtgggagggtaccgagccccagtaggtaggaggggtccaggaagcagaaattcctggaggctgcactggacaccgattacatctgtgggcgattagcacacgagccttcagataattgcttttgctttaagctgaagtttcccttttccttctgattgcaaagatcacaggaggttcagaaaatacagaaaagcccaaagaaaagaaaaataaccacaacaagtagctggctggacctgtcttgagaaccaaaattcactgctcatcctcattaggttttatacctttcttaccaagaaagtgctgttaacttcttaaaagctaaaaaagcaaaagctgctcagagtaaaaaccctgtgttcttcatttcagggacagggaaggcttgttttgagaaatgca

SEQ ID NO: 9813 - DNA, 857 bp, Homo sapiens
gtgactggcttccctgcctcccttttcaaccattctcaggcaagcagatttgacttgatcccatcatgtccctgcatacaagccttcagtagaatctaccaatatcagaataaagtccaaaatctttaacctgtggcctcccagggttttgggtatcggcttctccttgcctctcatctccgccatccttttcctgctctatacttcggccaggctgctaccctctcccctccaagcctgtgcacattctgtctgggacccttttcccagcagtgcctcctgaatagatgcgatggggatttgtcacctaaagtttcacgtggggcagttctcctacccagcatacagcatattcttcactgcattttcaatacctgttgcttttctgtatttgtcgtaagatgataaaagctctatgacaggagactgtcttatttctcctattgtttttttcagtaagtaccttgaatggcagattactttaaaaattataaaatggcaaatttgtttttataattagaaacctgctgtttaaaaacaaaaactagccaagcaggcatttgcctataatcccagctactctgggggctgaggcaggaggactgcttgagcccacaagtttgggtcagtttgggcaacatagtgaaacctcctctctaaacaaactaaaaaccaaaaattaaagctacttaaaggaaaccacatgattctgtcagtaacatacactgataaatctaacactaatcaatcttttttagttgataatgggttaataggaaaacttttacttaggaagacctacttcaaaataacctagatgctcgtctataccagcagacccaatcagacatagtagc

SEQ ID NO: 9814 - DNA, 790 bp, Homo sapiens
aaaattagcctggcttggtggcgcatgcctgtaatcccagctactcgggaggccaaggcaggagaatcgcttgaacccggggggaggaggttgcagtgagccgagatcgcgccattgcactccagcccgtggcaagagcgaaactccgtctcccccgacccccccgcttccccaaagagttacgtgacgccacttgatatgtgtgtgtgtgaccttggtcaagatcctaccttttgtgagcctgtttcctctgaggaacgtgataattgcctttactttgctgtgttgtcaggaattaagagataatggatgtaatagtctcactgtagtaggcgctctgttaacgatattttctccaaacgtttttgtcttttgtggttcagatccacaactgctggatttactagtctcaagcacttcagttgccactttttacaaaattattttgatttataccttattaggaaggaaaatattttatctcattgtttagaggatgagaggtggaatgtttgcttcgcgtgtgacagtattgctaagtttagaagtgaatttcagttcattgacttagaaaaagaacttgagattatctaggaaagttgaaaacgacccagcaattcctccctaagctttataccctagactgtaatgcctagagaaatccttgcacaggtaccccaggatccttgtacagaaaagtttatataccagcattcgtgctaacaggatattggaaacaacgcaaatgtctccataaattgtgggtattcgtacaattgaatcagccgtg

SEQ ID NO: 9815 - DNA, 312 bp, Homo sapiens
acttttactctgactagcattgtatgggagcttccctgagtgaatgctgcctttgaagtggggtcagagactgaggaccaaggggcacagagaaagaagagtgtggtcctcgatgggaggacccatcacaaaccgtcttgcacagtgtaaaccctggagaggggctgaagaaaccactgcagcccggggccgcccattctacctggcccatggtaggcactcaagaaatggtttgctacgtgaataaacaaatccacaaacatatatttctgaattcctatcatgcgtcaaacacaagagatagggagagag

SEQ ID NO: 9816 - DNA, 566 bp, Homo sapiens
ttatatcaatactctgagacttcaatattctttctttttttatgtaaaatggagatactacaaaaaaagatcagccccagcctatcttctccttttaaaattcctcacacaagtaaaattctggtgtctaaatcatgactggacgaatccaaagaaatcagaaaattatcaagacaccagctaatttcttcacaaggtagcacaagtatgaagctaataaaaagtcatgtaacaattattgatacagatatagccatctaaccttcaaatagacctataaaaagttaacttttatacaatgaataacacatctacttaatactcaaaatattgcccctacctttccatcccttctaattttgagtcatttatttggtttagtatcttacatctctctaaaaacagcttagaaaacaaaaacttccataagacaaggaagtaagatatagtaagtgattattaaatacttacttaatatttaataagtaagtgcttgcatatagaaaatcatgaaaaaggcccaaagtaatagtttctggtgccaaagagaaggaaatagattaacc

SEQ ID NO: 9817 - DNA, 473 bp, Homo sapiens
  misc_feature (15)..(15): n is a, c, g, or t
  misc_feature (37)..(37): n is a, c, g, or t
  misc_feature (87)..(87): n is a, c, g, or t
ctttaagtgtataanaatggaagggatagagttaaangaattggtgaaaatgatggcgaagtcagtcatgctattaaaggagtgccnagagagttcctcggggctgctaatacgtagatcacctaaacactcattcctctaacgcagagcacttcaaagatgagtagcacagaactctctcgttatctaatggagttggtgtaatgcaggccattgcaaccactaaaagttagctttgcatcctccaggcctccagaagtgtatataaattgaaagcttgaagaatctctctctggccttatcaaccctgctgtgaccttatatgaggtccataggaatttatattaatttgataatgactctgcaaacattagaagttcaattatgctcttttcctaaattcctattaattatatataactacgagtgttttattactgtatattaccatattagatatcattccatagata

SEQ ID NO: 9818 - DNA, 264 bp, Homo sapiens
ccactgtcacaaacactatctaaacgtcatacctgatctaaccaatctgtgaaccctatgtaaatcagacacggcttcctcaaacctgactggtcttttgtgatagcagtttgacttgaatggttttgtttttacaatctgttttaacgaagaaatgtgaacagtgattattaggattgataaattttgtgtttggggaacaggtgcacctgttccccaaacacccaccacccctggctaatttttgtgtttggggaacaggta

SEQ ID NO: 9819 - DNA, 566 bp, Homo sapiens
tgagaagtaaatgtaacgtcctgagtatctgtcagaaaaaatactaatgaatacgatcaatcttatgagctgccccaaaattgtttcagtatgttaacaattggattacagtaaagaacaagttgttaaagtatacttatattggctggaaacattgcatcatcagaccttgatgaattttccacttgtttcaatctattttggttttcattttatcacctattgctaaaagtttcactgtgttaagtttcagacaacatgaatgttaacacaggttttaggcgaatattggcatgccagagccgttatcatgcagcaagtgctaagctcccttactcatggagtgtttcagcggttagctttgacaaaattagtttctccaaaaccagaaagacacttttgtgatagcagtttgacttgaatggttttgtttttacaatctgttttaacgaagaaatgtgaacagtgattattaggattgataaattttgtgtttggggaacaggtgcacctgttccccaaacacccaccacccctggctaatttttgtgtttggggaacaggta

SEQ ID NO: 9820 - DNA, 453 bp, Homo sapiens
ctgaggcaggagaatcatttgaacctgggagacggaggttgcagtgagccgagatcacgccactgcactccagcctggtgacagcgagattctgtctcaaaaaacaaaaaagtatttagggtaaaaaacaaggatatactttttgctatgaaatatatcttatggccaggcgtggtggctcatgcctgtaatcccagcactttgggaggccgaggcgggtggatcacctgaggtcaggagttcgagaccagcctggccaacatggtgaaaccccgtctccactaaaagtacaaaaattagccaggtggtggtacacacctgtaatcccagctacttgggaggctgaggcaggagaatcacttgaacccaggaggcaaagttttcagtgagctgagattgggccactgcactccagcctgggtgatggagtaagactccgtctcaaaaaaaaaa

SEQ ID NO: 9821 - DNA, 430 bp, Homo sapiens
cattctcacttacacttatcatcgtttgtctttttatttaggcctcctaatgggtatggagtggtatctcattgtggttttgatttttatttccctaaaggctaatgatgttgagcatcttttcatatgcttattagccatttgtatatcttctttggaggaatgtctactcagatcctttattcatttttgaattgagtttgtctttctattattgacttataagagtttttgggccaggtgcggtggcttacacctataaaaccagcactttgagagaccaaggcagaaagatcgcttgagcccaggagtttgaaaccagcctgggcaacatggcaaaatcccatctctacaaaaagttaaaaaattaaccaggcatgatagtacgcacctgtggtcccagctacttgggaggctgagctgagagggt

SEQ ID NO: 9822 - DNA, 286 bp, Homo sapiens
tttatcaccccgtggggtaggtacctcatcgccccaggaggaaaccgtggcacacagggaagcgcctagcaagtgaagtggtagagctgggatctgggctgtcaccctccagcgcctgtgtgaactgtgctttctcaataaacattcacgccacacccagataggaagtgcctgatctgagccagtcctgtcctaggcacctgggagggcagaaaatatccttgccctcatgcacctgagctcacattccagtggagctgactaagtatgaactccgtgtatagtt

SEQ ID NO: 9823 - DNA, 334 bp, Homo sapiens
taaactgcctattcaaatcctcgtcgacccattttctatttggagttctttgtacattaagcctattaactttccaatacatttgctgcacatttttgtagtccatgatttatcttgttattgcttatgtaatcttttcatatataaaaatctttaatatttgtgtaatcaaatgtttttttcctttatgattcctagtgtttcttgttctgcttaaaaaggtcttttccatcgcaaagttctacaaatatatgcctagattttcttcctatatttttattgttttgtttggatttttatgtaattaaaattattttgtttagcagatccaatg

SEQ ID NO: 9824 - DNA, 882 bp, Homo sapiens
cttggcctcccaaagtgctgggattacaggcatgagccgccacgcccggctaatttttggtatttgtagtagaaacggggtttcaccatgttagccaggctgggtgcgaactcctgacctcaggtagtccacccgccttggcctcccaaagtgctgggattacaggcgtgagccaccgcagtccggccctaatatagtttttaaattcattcattccaaggcttttgggaggcgctcagtggcgtgcagtttcctctcgaatttctttcttcccgcagtctttctgggcgggcgtctcccgtctgtttcttcccatcttcccccttatcatcctgggactggataattcttgaatagtctgggaggtagcagggaacccgagttcggagcctcgaccagaacctccagacgggaaattggagcaggtggtgtcgttccaggacgctgaggaccacctcctcccctaacgcacagcccaacgatcctaaaagtaaaaaccctgagtttctgagtcaagactgagctggtggggtggggaccgagtaggcgtggatggggagcccagcggtccccagcggagaaaatgggtgagacgcctggggccgcggtctccagaattcgcctgggagggagagtggcgctacggcgcgccttcctggggagccgcttcgggctccggattgtccgctggggcccgacgcttgggtcccgacgcgcggttcgcactttccaggtttcttccccagggaacagagcttgagcggggggccacccccccgtcctaccggagttctgaggtgcggtcaggcgcggagagcggacgcccagcgccagattctgtgggctccggagttcaggcccactgagccgcagctgagcaca

SEQ ID NO: 9825 - DNA, 1300 bp, Homo sapiens
ttcgaagatgatgggatccccaaatcagctagcagccccacagccctcccgccttcctcccctctctccacgcctcccccaggccggcgatgccgtcagggcccgtgtctgaggcgtccggtggattcagcagaacaaacatcataaaaagattatttgcgagaggagaagacgatgctgtgagaacttggtcccagagaccgtctcagagcagcagaaaaaccgcaggaaacctaaggagcacgaccctgacggcgacggagggggtgcgcgcggacagcactgtcacctcccgccgacgccagggctcaaatcggaacgaagactgggcggccacaaatgccggcttctcctttctttcgctgaggcggagaaatcgcccagcggtgcccggcgcgcctcccgcggaaagcgggcggtgaccattccgacaggccgtccgcagcgctccctttccgcagacaaagctgcctcgaaaggcgctccgcggctcccgagtcaccacgttccattcggcagaagaaagcgaaagcggccgctccctgtcaggcagccagacaatagcggcgggcaggccgctccacgccagcatctttgtttccctcgcgccgggaaacgaagtctccggataccacagaaaccagaagccgataccacagaaaccagaggccgctcttcccgctcggacgtttacagcgggcgggagcgtggcggccacctccgtcttggggaagcggcaggttgagccccgcaccttgctgtgccctctagagcgagcggaggaagcaggcgaaaagctgctgcgagatgttgcggccttgcagacgtctcagctcctcccggcacggcggcctggtaaggcgggaagtagcgccggccccgcgcggaaggaaacgtgcagcgcgatgcggcttagcgcggctttatagagccgaggctttatagagccgcgccccggcgacccctgcggtgactgctgtcggtccgcgttgtgtgtgttctctgtttcggcctccgctgcccgctgcggccttgcccctgcgcctcggagtagccgccgcgggcctgtctgctggagcaaggagacccggaggccgtcccaggggcgagggggtagcggccccggcctcttgggccctcggcctcgcgcccaccgagccctctgcccgggtttggttgggtgtggagcttgcgacgcgcccacttcctgggctgtgcttctgcccgagctgatgcctcgccgcgacgccaggccctatcttgacagcgggtgccagcaggtccaggcctactgacgggc

SEQ ID NO: 9826 - DNA, 490 bp, Homo sapiens
tggtgataatgagaatttgcaccaaaaacaaacaaacaaaaaaatgaaacaaacaaacaaaaaagcttctgaccagtaatttttaaataaaaacttaaatttgaaattcaggaatatagaacagattaaatgtacaaaaaagcaggaaggtttttgtaatatactcatcatgtacatcaggagtgtctaaccttctggctttcctgggtcacattgaaagaattgtcttgggccacacataaaacacactaacacaactgctgatgagattaaaaaaaaaatcgcaaaaaaaaaaacccctcataatgttttaccaaagtttacgaatttgtgttgggccacattcaaagcttccctgggccacatgcagcctgcggcccactggttagagaagcttgatttacatgataacaaagtgacactgaaagaaaacatattgaaatccaaaatgctgaaggagtgagtgcagacccttaaatcacagctgcac

SEQ ID NO: 9827 - DNA, 322 bp, Homo sapiens
ccgtgttgggttagacacaggagcctgctgtcctgagtcttggcggggtgagtttgggcagtggcagtcaggggaatgtgcgtccacttccaaacacagtgtatgcaggatggttggaatgaataaaggggctctggggccagacactctggagtggatttgtggctctgtgtgatctaggcccatttgttacctctctaagtttcaatttcttcatctgtaaacaaagaagagtaccagcagctactgcagtagagaagctgtgagtattacatagacaatgcatgtaaaaccacttagtgcagtgccgggtgtatcaaaa

SEQ ID NO: 9828 - DNA, 338 bp, Homo sapiens
atccattattaacaaattaactttgcattccactgtatgtgaagagctgatttctgtgagcacaacatgaactttgttatctgatatgattaggctttgtgtacccacccaaatctcatcttgaattatattccccagctgttgagaagaggcctggtgggaggtgactgaatcatatgggtgattttccccagtgctattctcatgatagtgagagggttctcacaagatctgatggttttataaatggcagtttcccctggacttctctctctctctctcacctgctgccatgtgagatgtgcctgcttccccttctgccatgattgtaagtttcc

SEQ ID NO: 9829 - DNA, 408 bp, Homo sapiens
aaagataagaatttttaccaagtttagctctcctggatctctacctggagtacctgatggagaatggaaggtaaacatttctctttatccctttctccctaaattcaggttggcaggagaaaatcatttgtttaggttgtgactcttgtgtaagtttggtttggaagacctatttataattatctttctccttttcatgggcagttatttctttcctgtctgtcttgttttgtgtcctgagatcttagcttggcctgctgcctgtcggggtcatgcaggttgttgggtcatgcagatggtcaactgaaagaggttgaggcccacatataaaactaacatatcaacttgccagctctaaaaacattgtctaaatatttctcttttttaacttttattttaagtttgggg

SEQ ID NO: 9830 - DNA, 1691 bp, Homo sapiens
cacaactgcttccagccggacggagctcggccggctgcgccggggcctgtcccaggtctgcagtggggaacctgccgggccacgttggtggggcctgggccgcaccttcggtcagtgtggaggcccggtggctctggcccgactgggtggcgggtgtgggggcaggctggggcctgggggaggggcgaggtgccgtgggtggcggccgaggaggcatgaaattgctgcagatgcttcttcgggggaatccctgctgcccgcagcctgagatcagcccgcaaggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgtcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctagccacgcggagagggcctcagcccccacctctggcctgcaggagtgtcgaggtccccgaggcgctctcctgtgaggaggtggctgggccacagtgtggcctcttccgtttgtgtgcgcatgggagtggagggcaggattggggcagggctcctcaggcagtgacccttcagccttgcagccttggaagctgggaggctggacctggttggcccctccccaggcaggccagggcccagcagcttgtcccgctgtccctgtgcagaccataggtactgggatgttgcccttccttgccttgcagtcaccccagaagccagagagacgcatctgtttacctgccacccactctgcgagccaatctcagttgttgttcttgttcttcttgttctttgtaaatattgagaaagttaaaagaataaagacatttcttttggagtttccata

SEQ ID NO: 9831 - DNA, 1477 bp, Homo sapiens
gacttttcattcctggttggtgcctgggagagtgacgaggcctatcagtactggaggacacagtcaaggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgtcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctagccacgcggagagggcctcagcccccacctctggcctgcaggagtgtcgaggtccccgaggcgctctcctgtgaggaggtggctgggccacagtgtggcctcttccgtttgtgtgcgcatgggagtggagggcaggattggggcagggctcctcaggcagtgacccttcagccttgcagccttggaagctgggaggctggacctggttggcccctccccaggcaggccagggcccagcagcttgtcccgctgtccctgtgcagaccataggtactgggatgttgcccttccttgccttgcagtcaccccagaagccagagagacgcatctgtttacctgccacccactctgcgagccaatctcagttgttgttcttgttcttcttgttctttgtaaatattgagaaagttaaaagaataaagacatttcttttggagtttccata

SEQ ID NO: 9832 - DNA, 1519 bp, Homo sapiens
cacaactgcttccagccggacggagctcggccggctgcgccggggcctgtcccaggtctgcagtggggaacctgccgggccacgttggtggggcctgggccgcaccttcggtcagctcggtgcccttccttggagctgccggccaccagcagagcctaccctcttcatggaaagcctcgtgcagtggccccctggtgatggcatccgacagtgatgtgaagatgctgctgaacttcgtgaacctggcgtccagcgacatcaaggcagccctggataagtccgcaccctgccgccgctccgtggaccatcgcaagtacctgcagaagcagctcaagcgcttctcccagaagtattcccggctcccgcggggccttcctggcagagctgctgagccctacctgaaaagggggtctgaggaccggcccaggaggctgctcctggatttgggccctgattccagccccggcgggggtgggggctgcaaggagaaggtgctgaggaacccctacagggaggaatgtcttgctaaggagcagctcccacagaggcagcatccagaagctgcccagcctggccaggtgcccatgaggaaaagacagctgcccgcttccttctgggaagagccaaggcccacccacagctaccatgtggggctggaggggggactgggccccagggagggacctccctatgagggtaagaaaaattgcaagggcttggagcccctgggacctgagactaccctggtgtccatgtctccaagggccctggctgaaaaggagccgtcaagatgcctggggtctccttggtgggccgcgtcaatgcctggagttgctgccccttccagtaccatggacagcccatctatccgggccccctgggggcactgcctcagagtcctgtccccagcctgggcctttggaggaagagcccagcctttcccggggagctggcgcacctctgcaaggatgtggacggcctggggcagaaggtgtgcaggcccgtggtgctgaaacccatccccaccaagccagccgtgcccccacccatcttcaatgtctttggctacctctagccacgcggagagggcctcagcccccacctctggcctgcaggagtgtcgaggtccccgaggcgctctcctgtgaggaggtggctgggccacagtgtggcctcttccgtttgtgtgcgcatgggagtggagggcaggattggggcagggctcctcaggcagtgacccttcagccttgcagccttggaagctgggaggctggacctggttggcccctccccaggcaggccagggcccagcagcttgtcccgctgtccctgtgcagaccataggtactgggatgttgcccttccttgccttgcagtcaccccagaagccagagagacgcatctgtttacctgccacccactctgcgagccaatctcagttgttgttcttgttcttcttgttctttgtaaatattgagaaagttaaaagaataaagacatttcttttggagtttccata

SEQ ID NO: 9833 - DNA, 266 bp, Homo sapiens
ctcatgaaaaattgaaggatatattctagatgagtgtttggagaaatctgatggactcttgggaaagtaaattataaaattaaaacatatttttttttcagtaaagtgtaaaactggtcatcctccacctgaaagagaatactaaactttaaaccaaaatataaaaagaaagattgctagttgttttttatctaatcctttttggtgaaaatattagtttgaaaattgttatctaaggtccctgccatcatttggaaagtcaagtg

SEQ ID NO: 9834 - DNA, 454 bp, Homo sapiens
gccgggtgctggcatagaggaggagaggtggccataaatttcagagaatcttcccagcctcctctaatcccatgccaagaaatatgacagattctaggcccagagaggccaagaagatgaaaacatttctggcactttctaaagtttctgtccagaaaagccatcagctgaaggggcgcaggatgacaaatggctgccggatctgcaggttccgggttctgagacaggaaccctgccacatcatgtaaacaatcccggactagcctgctggaggaagatagactgtggaacagaattgagttccacaaggctccagagacatgagagaacccaactgagatcagcagagcagctacctcacccatggctgaccacagatgtatgagtgtgtccagaagaactttctggtggccccataggtttgtgaacaataataaatgcttatcattttacc

SEQ ID NO: 9835 - DNA, 483 bp, Homo sapiens
tcttgcttttgtctcccaggctggagtgcagtggcacaatctctgctcactgcaacctcggcttctcaggttcaagcgagtctcctggctcagccttcccagtagctgggattacaggcgcgtgccaccatgcccggactttggagtttgctgaaatgtaacctcagaataagtggggtatgactgccctctcctttgagggaaaagaaaaagtattttcaggccaggcacggtggctcatgcttataatcccagcactttgggaggctgaggtaccataaatatgaaaaggcaagatattggcaattcagtacaacttgtttgtgtccagaatacatcaataaaagaagaacaattcaagagaaacaggaaattcacagaagaggaaaccggaattgtcataaacaaatgaaaaatgctcaacttccctagtaattatgagaattcaaatcaaaataaagacttcatttcacacttataaga

SEQ ID NO: 9836 - DNA, 454 bp, Homo sapiens
ccctggaggcccctccagagagggacccggggccccgcccgcagctggagaaggggtgaatgcctttcctacctaacgcctggtccgcggccctgcttgttgcgtctccaagaccacgtgtctgctgcattttaaaaatagttgtgaacatctgactttctccttttactttggagtttgctgaaatgtaacctcagaataagtggggtatgactgccctctcctttgagggaaaagaaaaagtattttcaggccaggcacggtggctcatgcttataatcccagcactttgggaggctgagaatacatcaataaaagaagaacaattcaagagaaacaggaaattcacagaagaggaaaccggaattgtcataaacaaatgaaaaatgctcaacttccctagtaattatgagaattcaaatcaaaataaagacttcatttcacacttataaga

SEQ ID NO: 9837 - DNA, 439 bp, Homo sapiens
aaactagattccttcctcacatcgtacccaaagatagactccggatatattttttaaaactaaatataaaaagccaaactttaaaacttaaaaaaaatctgcaagcaaatacaaccatgaacttgaagggggtgggtttcttaaataagatgagaaggacatattttataaaggaaaatgttgatgaatttgactaccttgaaattttaaacttctttatgatgaaaggtaccataaatatgaaaaggcaagatattggcaattcagtacaacttgtttgtgtccagaatacatcaataaaagaagaacaattcaagagaaacaggaaattcacagaagaggaaaccggaattgtcataaacaaatgaaaaatgctcaacttccctagtaattatgagaattcaaatcaaaataaagacttcatttcacacttataaga

SEQ ID NO: 9838 - DNA, 437 bp, Homo sapiens
ttttttttttttgagacagagtcttctggttcttttgcccaggttgaagcacagtgacaccatcatagcacactgcagccttggcctcctaggctcaagcagtcctcctctcttggcctcccaaagtgctggaatacaggggtatgccaccatgtcaggctactttttatttttatttttttaagagacagtcttgatctgttgcccatgctggtctcgaactcctgggcttgaacattcctccctccttgacttcccaaagtgctgagattacagacatgggccaccatgcctggccttaatttgggtatcttctaattgatgtggactcttatgccctattcatttgtgttttgaagtgaactgactctgaatgtcagtgatagggcactgcttagtgttgggggtggttaggaagatatgcaagtttcttagag

SEQ ID NO: 9839 - DNA, 499 bp, Homo sapiens
gctgtggactggagccttagctggggccttagccagcaaatctatacctaccttccccatgtggcctgggcttcctcacaccatggtggctgggttccaagggcatgcgtcctgagagaggcaggtataagcaatatatcctgttatggcctagagtcatgaactacacagcattgcttccagcacattctgcacagaagtagtcacgaaggcccagccaatttcaaaaggagggaaaacagactctgccttttggttgggaagcagcagtgttctagaagaacacgtgggaccaagatgtggccattttgagaaattgtaatctgtcacaattttgtacaggtctgtcatcggctgtgacctaccctggggtggagggtggtggggggtgaatacaaacacccaggtgctttcggctgagaaaaggatctgcagtaactgaaaggttatcttcttaagatagtcactggtatggggtgttcataataaaggcatatag

SEQ ID NO: 9840 - DNA, 1002 bp, Homo sapiens
aatttttttttttttttgagaatgatgcccgctgcaaaacgaagtaacagaaggctggctctgaaacaccacacttcttggtcttaacgttaaaatgcttttctagagcagaagggaaaaagagttatcagtgctttcgtcccacaaaaatagttcctgtttcactaaattttaccactgcctttagaattagtaaatgaaaacgccaacttgtagaagcattaagttaatgcgatttagaaattaaatagtaaccggcctcatcacacagataaggttaggcttcttcagccaggggcaatttctgtcctaattgtcacagctgccttaatgctgtactttctgcgctgtagctgccaggaggcagataagatttttctctctgaattaattctgggaaaggtggcactttttataggccttaaatgacccttttctaagattttttgttggtggtgtccagatgttccaataatactggagagttaactattccttccaaacctgtgtcgttcaaactgccttgaggagaacgggaaaaaagtaaggttcacactcgaaaagtttcactcggggtggggtgaggacgaggtaggaaggaaacgacagtacgtatcgttcgtaactatcgtacaatacgtatcgtttccgaagctagaccggcagctggcacagtctttcccctttccaggtcctggggagaaacgtctctcgctgagggggctagacacctacgacagcctcctcctcgggaatcaacacagctctggatcgtgacacgcttccagaagtccgtgacgagtgggggcagaagacaggttcttcgcttccccttcacccaaacacgtcccaaattgttcgaggcaggaagagcacgcctctctcatctccccaagacctactctcgctcagctccctcgccctgtttcctctgggggcaccgccaccccgctcgggactcccgcctctggccacagcagccccggagcggcaagggggaag

SEQ ID NO: 9841 - DNA, 436 bp, Homo sapiens
tcttattttcaaggaagcaatatctgctatacatttaacagccagctgatggcctagtgtatacctagtactcaatactttttgttaaactattgaaacaaagaaaaaatgaatgaatttagcagtaatgtagatcatcttttcccttaggcttgggaaaccaaacctaaacattagcaatcattaataataacctgtaggccaataggcccagagaatgaaaaaatccgtagggatgtttttaataagaatgttaacaaaaggttaaccttatgttgaaagatactttatataattttaaacctctataattcataaatcgttttataaaatccagagactctcaaaaatatctgtaatataatagctacctagggcatgtttgtaccctttggattgctactgaaggtttaagatagctatatacctatacacc

SEQ ID NO: 9842 - DNA, 458 bp, Homo sapiens
cctgggttcaagtgattctcctgcctcagcctcctgagtagctgggatcacaggcacgtgccaccatgcccagctaatttttttgtatttttagtagagacggggtttcatcatgttggccaggatggtctcaaactcctaacttcaggtgatccacccacctcggcctcccaaagcacagggattacaggtgtgagacactgcgactggcccattattccttttttggatggcaatgtgcttttaaagaaaacaggcagtttagaaacagatttcatctgttagtaatgcttccttttttgattgtggcaggaaactcctttatctttttatgttttagttccttcttcagcttttccaatcatattgtttctttttgctcctttatgaggccttttgtcttgcctttaggacctaatggattcaggttatgaagccactttttctgtatacttcct

SEQ ID NO: 9843 - DNA, 413 bp, Homo sapiens
cgtggccgcactatctaatctttaaagagacaaaaatattcttccaaaaatggttgtcgtaagtgttcttgtatataatccttcttccagtgatcaaatttgagctgaaaaaattgttggtaatatttaatttgctgaggcaaaacaaatcattcatggtttgtcaatttgtatttattttacaaagaacagtaaatgttccatctggcagtactaaaatgcttatttaccaggttactcaaaggttattctacctaaactgagagcaagctggccatataaataaatggtgaaaaatacaacaatgttacctagaaacctaaaaaaccttaaaaagtcaaagctttttcaaggaaagaagttaaatcttaaaaataaaattaaggtaaaatgcctttttaaggggaggtttt

SEQ ID NO: 9844 - DNA, 993 bp, Homo sapiens
gtagagctcagcagaaagtggctgttctactgagttaaaaagttagaggttagaatttggggcttccacagtagcaggagattgggaaggagggaatctcgcaaaggagggagtctcagatggggagctcccaaatctgtgtacaaacttctctgattcctaaactgtgcatctgggtgaggttcaaggagctgagggaaaaataacggctggaaggctaaaaaggtgttgtcttgtgttgagcagatggtgcttagggtttagttctcaccaagttagaggactctggagaacacctaaagctttctactgagactacagaaggagtaatgattactccccaggactaaagcctatgtcctaggaataaaggcaaaaccaagataggcccaccctgacaaagcctaaaaccaactcttcatagccgcattatgcaatatagtaacttctaggcacacatggcatttcaaatttaattaaaactaagtaaaatttaacatgtagttcctcagacacactagccacatttcaaatgttcacagacacatgtagttaatggctatgatactggactgcacagactacagaatatttctatcatcatggaagttctattgaatggcattgctctataggatcaagactatgctagtaatttaactgcttgatagaacaaatgtcaaatttcttctaaggaagatagtagactccaaagtctttttaatatcatccaaaatgctcagcatacaatttttaaaaattactaattgtgcaaagaatcaggaaaatgtaacctacagtgaagagaaacaacaggtgataaacatagactcacaagtgacccagatgttagaattacaaaagacttaataactataataagttaaagagtctataggaaaatatatctgtagtagctgaagagatggaaaattttaagagagctatggaaactttaaaaaagaaccgaatggaaatcctgaaactgaaaga

SEQ ID NO: 9845 - DNA, 795 bp, Homo sapiens
cggtacccagttcgacggagactctcaaaacagttcaccattcatataaaggttgaaaacaacaaattgagaatgaatactggtgaactgttttgggaggctttttcaaaatttgtgctttgctattgtattcattttctactgctctgtaacaaattaccacaaatttagcagcataaaataatactcatttacagctatgtctaggttctccgctcagggaatcacaaggctagaaatcaagattttggccaggctgagttctcatctggagtctctgggaagaaatctacttccaacttcattcagattattgggaaaatccagttccttgtgactggatgactgaggtctccattttcttgctggctgtcagccagcaatcactctaagcttctagaggccacccacatgccttctcatgttgcccctccatcttcaagccagcagtgatgcgctgagttcttctcatgctttgaatatctgacttcttctgcagccagctggaagaatatatacttttaaagggctcacttgattaggtcaggcccacccaggataacctttgttttgccatataatgtaacattcataggagtgatggcccatcacattcagttttcactcccactcaaggaaaggagattatacaaaggcatccatcatgtggggacaattagcttagaattctttataatgtagctctcacatgacaggttttctacttagtaccttttatggcatcaatgtaaatttaagctgtaaataaaaaacaaatatgtgaaaaaaaaacta

SEQ ID NO: 9846 - DNA, 780 bp, Homo sapiens
agcggggacttaggcaaggggtccaggtcagagtttagagctttcaaatcccaacttgcccctggggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggcgcgccgaactctgaaggagtggacactgcaggtgagcccgtttggtcggctgcgggcgcggctcccgtgccacctggccgtgaggcccctggaccccctcacctacccggatggcgaccgcgtgctggtcgcggtgtgcggcgtggagggcggcgtgcggggcctggacggcctgcaggtgaagtacgacgaggatctggaggagatggccattgtgtctgatactatccacccccaggcgtccgtggaggtgaacgcgcccctgaagtttggcaagtgaagtgaagtgaaaacgggtttgggtcccagggaacgcacagtgaacttaataaatgtggtcgacgtgcacttttaat

SEQ ID NO: 9847 - DNA, 1007 bp, Homo sapiens
agcggggacttaggcaaggggtccaggtcagagtttagagctttcaaatcccaacttgcccctggggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggcgcgccgaactctgaaggagtggacactgcaggtgagcccgtttggtcggctgcgggcgcggctcccgtgccacctggccgtgaggcccctggaccccctcacctacccggatggcgaccgcgtgctggtcgcggtgtgcggcgtggagggcggcgtgcggggcctggacggcctgcaggtgaagtacgacgaggatctggaggagatggccattgtgtctgatactatccacccccaggcgtccgtggaggtgaacgcgcccctgaagtttggtttagatatcaagtcatcagggtctggctgtgtaaaagttcaaagtattgagggtgataattgcaaaattgaaacagagcatgggactagtatcttgcagtctgttaagggtcaaaaattgcatgttcaaacaaaaggaggcaaagtgatctgtctgggaacagtttatggaaatatagatattcatgcatcagataaaagtatggtttgctgaaagccaagtatctttatacagaatcatcatttctgtcttctgctgctggggatattacattaggaagtgttcatggtaagctgacaaaggcataat

SEQ ID NO: 9848 - DNA, 2000 bp, Homo sapiens
agcggggacttaggcaaggggtccaggtcagagtttagagctttcaaatcccaacttgcccctggggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggcgcgccgaactctgaaggagtggacactgcaggtgagcccgtttggtcggctgcgggcgcggctcccgtgccacctggccgtgaggcccctggaccccctcacctacccggatggcgaccgcgtgctggtcgcggtgtgcggcgtggagggcggcgtgcggggcctggacggcctgcaggtgaagtacgacgaggatctggaggagatggccattgtgtctgatactatccacccccaggcgtccgtggaggtttagatatcaagtcatcagggtctggctgtgtaaaagttcaaagtattgagggtgataattgcaaaattgaaacagagcatgggactagtatcttgcagtctgttaaggtaatataacattacaaagcaagatgggtaacatcacagtagattcgtcttctggatgtctaaaagcctcaactaatcagggtgccatagatgtttatgtcagccaactggggaaagtggaattgaaatcccataaaggttctattattgtcaaggtcccatcttcacttcaagctcatttacagttatcagggaaagaggttgatgtgaactcagaagtccatgttcaggaaatggctgaagttcgtaaagatgatgttgtaacagtgactggactcatgaatcaagcaagcaaacgtgaaaaatggattaaggctgatgccccaaaaggcactgtaagttttagaaggcaaagttggtttcagtccctgaaactgcaggactaaaactgatttgagttggatttatgatttttaacaatgattcgcagatctgtgactacaaaaatgtaaatcccaccattcatataaaggttgaaaacaacaaattgagaatgaatactggtgaactgttttgggaggctttttcaaaatttgtgctttgctattgtattcattttctactgctctgtaacaaattaccacaaatttagcagcataaaataatactcatttacagctatgtctaggttctccgctcagggaatcacaaggctagaaatcaagattttggccaggctgagttctcatctggagtctctgggaagaaatctacttccaacttcattcagattattgggaaaatccagttccttgtgactggatgactgaggtctccattttcttgctggctgtcagccagcaatcactctaagcttctagaggccacccacatgccttctcatgttgcccctccatcttcaagccagcagtgatgcgctgagttcttctcatgctttgaatatctgacttcttctgcagccagctggaagaatatatacttttaaagggctcacttgattaggtcaggcccacccaggataacctttgttttgccatataatgtaacattcataggagtgatggcccatcacattcagttttcactcccactcaaggaaaggagattatacaaaggcatccatcatgtggggacaattagcttagaattctttataatgtagctctcacatgacaggttttctacttagtaccttttatggcatcaatgtaaatttaagctgtaaataaaaaacaaatatgtgaaaaaaaaacta

SEQ ID NO: 9849 - DNA, 2014 bp, Homo sapiens
agcggggacttaggcaaggggtccaggtcagagtttagagctttcaaatcccaacttgcccctggggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggcgcgccgaactctgaaggagtggacactgcaggtttagatatcaagtcatcagggtctggctgtgtaaaagttcaaagtattgagggtgataattgcaaaattgaaacagagcatgggactagtatcttgcagtctgttaagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatggtttgctgaaagccaagtatctttatacagaatcatcatttctgtcttctgctgctggggatattacattaggaagtgttcatgggtaatataacattacaaagcaagatgggtaacatcacagtagattcgtcttctggatgtctaaaagcctcaactaatcagggtgccatagatgtttatgtcagccaactggggaaagtggaattgaaatcccataaaggttctattattgtcaaggtcccatcttcacttcaagctcatttacagttatcagggaaagaggttgatgtgaactcagaagtccatgttcaggaaatggctgaagttcgtaaagatgatgttgtaacagtgactggactcatgaatcaagcaagcaaacgtgaaaaatggattaaggctgatgccccaaaaggcactgtaagttttagaaggcaaagttggtttcagtccctgaaactgcaggactaaaactgatttgagttggatttatgatttttaacaatgattcgcagatctgtgactacaaaaatgtaaatcccaccattcatataaaggttgaaaacaacaaattgagaatgaatactggtgaactgttttgggaggctttttcaaaatttgtgctttgctattgtattcattttctactgctctgtaacaaattaccacaaatttagcagcataaaataatactcatttacagctatgtctaggttctccgctcagggaatcacaaggctagaaatcaagattttggccaggctgagttctcatctggagtctctgggaagaaatctacttccaacttcattcagattattgggaaaatccagttccttgtgactggatgactgaggtctccattttcttgctggctgtcagccagcaatcactctaagcttctagaggccacccacatgccttctcatgttgcccctccatcttcaagccagcagtgatgcgctgagttcttctcatgctttgaatatctgacttcttctgcagccagctggaagaatatatacttttaaagggctcacttgattaggtcaggcccacccaggataacctttgttttgccatataatgtaacattcataggagtgatggcccatcacattcagttttcactcccactcaaggaaaggagattatacaaaggcatccatcatgtggggacaattagcttagaattctttataatgtagctctcacatgacaggttttctacttagtaccttttatggcatcaatgtaaatttaagctgtaaataaaaaacaaatatgtgaaaaaaaaacta

SEQ ID NO: 9850 - DNA, 1264 bp, Homo sapiens
agcggggacttaggcaaggggtccaggtcagagtttagagctttcaaatcccaacttgcccctggggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggcgcgccgaactctgaaggagtggacactgcaggtgagcccgtttggtcggctgcgggcgcggctcccgtgccacctggccgtgaggcccctggaccccctcacctacccggatggcgaccgcgtgctggtcgcggtgtgcggcgtggagggcggcgtgcggggcctggacggcctgcaggtgaagtacgacgaggatctggaggagatggccattgtgtctgatactatccacccccaggcgtccgtggaggtttagatatcaagtcatcagggtctggctgtgtaaaagttcaaagtattgagggtgataattgcaaaattgaaacagagcatgggactagtatcttgcagtctgttaagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatggtttgctgaaagccaagtatctttatacagaatcatcatttctgtcttctgctgctggggatattacattaggaagtgttcatggacttgcctcattgggatctaattaaatgaaagagcttctgcactgcaaaagaaattatgaacagagtaaatagacaacctacagaatgggagaaaatatttgcaaactctgtatctgacaaaggtttaatatcctttgttcctttgaatcttcaaggaagttaaacaaatcaataagcaaaaaactaataaccctattaaaaatgagcaaaagacaggacattttgctcatttctcaagagaagacg

SEQ ID NO: 9851 - DNA, 1265 bp, Homo sapiens
agcggggacttaggcaaggggtccaggtcagagtttagagctttcaaatcccaacttgcccctggggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggcgcgccgaactctgaaggagtggacactgcaggtgagcccgtttggtcggctgcgggcgcggctcccgtgccacctggccgtgaggcccctggaccccctcacctacccggatggcgaccgcgtgctggtcgcggtgtgcggcgtggagggcggcgtgcggggcctggacggcctgcaggtgaagtacgacgaggatctggaggagatggccattgtgtctgatactatccacccccaggcgtccgtggaggtgaacgcgcccctgaagtttggtttagatatcaagtcatcagggtctggctgtgtaaaagttcaaagtattgagggtgataattgcaaaattgaaacagagcatgggactagtatcttgcagtctgttaagggtcaaaaattgcatgttcaaacaaaaggaggcaaagtgatctgtctgggaacagtttatggaaatatagatattcatgcatcagataaaagtgctgtgaccatagataaactgcagggaagttctgttactgtatctaccgaagatggtttgctgaaagccaagtatctttatacagaatcatcatttctgtcttctgctgctggggatattacattaggaagtgttcatgggtaatataacattacaaagcaagatgggtaacatcacagtagattcgtcttctggatgtctaaaagcctcaactaatcagggtgccatagatgtttatgtcagccaactggggaaagtggaattgaaatcccataaagggtatcactctgtcacccaggctggagtgcagcagcaagatcatggctcagtgcagcctcatcaggatcgcctaagcttgggaggtca

SEQ ID NO: 9852 - DNA, 1202 bp, Homo sapiens
agcggggacttaggcaaggggtccaggtcagagtttagagctttcaaatcccaacttgcccctggggattgcgcggctgatgtttagaacgcctagtcaagccaaccggctcgctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgctcaggttgggagcttggctgcttccgtctctgtctccgtcaggtccgactgtgggctggcgctgggcgctgggcttgctgggcttgccaagccaggccgtacagctcaggtgggagcgagcgctggcccggatcggagactgaggtccctccgcctggcccggcgcgccgaactctgaaggagtggacactgcaggtgagcccgtttggtcggctgcgggcgcggctcccgtgccacctggccgtgaggcccctggaccccctcacctacccggatggcgaccgcgtgctggtcgcggtgtgcggcgtggagggcggcgtgcggggcctggacggcctgcaggtgaagtacgacgaggatctggaggagatggccattgtgtctgatactatccacccccaggcgtccgtggaggtgaacgcgcccctgaagtttggtttagatatcaagtcatcagggtctggctgtgtaaaagttcaaagtattgagggtgataattgcaaaattgaaacagagcatgggactagtatcttgcagtctgttaagacctcttagaaaatctaattgtctccttaagaagaaaaaaatgcatgtctatgaaattttacttataattttgtaagttcatgtgagcttggttaagagttcttgacttaaaacaacaagtgtgcgcctcccgtcgcccaagatgccgaaaggaaaggaggccaaggggaagaagttggctctggcccctgcttttgtgaagaagcaggaggccaagaaagtggtgaatcccctgtttgagaaaaggcctaagaattttggcattggacaggacatccagcccaaaagagacctcacctgctttgtgaaatggccccgctatatcaggttgcaatggcagagatccatactctataagcagctgaaagtgcctcctgcgattaaccagttcaccca

SEQ ID NO: 9853 - DNA, 458 bp, Homo sapiens
tgcaactcctgcccagttcagactatctttaccaagattcttgatgttctaaggtgtttttcagtttcagagatgtgttgctaggatctatgtggtcaattaatgctcttgatataattttatgcaattttgtgttttaggactcatgaatcaagcaagcaaacgtgaaaaatggattaaggctgatgccccaaaaggcactgtaagttttagaaggcaaagttggtttcagtccctgaaactgcaggactaaaactgatttgagttggatttatgatttttaacaatgattcgcagatctgtgactacaaaaatgtaaatcccaccattcatataaaggttgaaaacaacaaattgagaatgaatactggtgaactgttttgggaggctttttcaaaatttgtgctttgctattgtattcattttctactgctctgtaacaaattaccacaaattta

SEQ ID NO: 9854 - DNA, 468 bp, Homo sapiens
gatctgttccatattctgcagagaatgcactattgctcagaatctcgtaattagaggtagggaatcagagtcaataaagtgattgtgtactaggtagtaacattttatgtagttatccactgattccacaggtagcattttggctttttaccagtctttgttttataatgaactgattagtctttctcttactaggctgtgaccatagataaactgcagggaagttctgttactgtatctaccgaagatggtttgctgaaagccaagtatctttatacagaatcatcatttctgtcttctgctgctggggatattacattaggaagtgttcatggtaagctgacaaaggcataatacatctgagactttccacatagcataaattttaagagatgactctgtagttgaaaaaaggatcaggaaactggccttttaaataatgaaatgcagactaaccatctttttaaa

SEQ ID NO: 9855 - DNA, 633 bp, Homo sapiens
ataatattaatgaaattcaaatgtatcatggataaaaaataaaaagatttctcaaaagtcagtaaaggacaaatgaaggcaggaagaaaaaatcaaatgtgtaatccactgtgggatcttaatatcaagattcaaatatgtaaaatgattgcttttaattttgaatatgagttttgtaatgtagaagttaagagagttttatggagctataaagaatgcagtgagttgacaaccattttccttagtatttttccccaagaaaataagtgtgaaacccgttgataagcataccacatgtataaatgactattctagattcctctctctctccttctgttcctttcttctgtctttctccctccctccttctcttcctttctttcttccttttctctctccctctctccccttctccctctccttctctgtctttctccacccctcccatgactttttcttttttttttaaattatactttaagctttagggtacatgtgcacaacatgcaggtttgttacatatgtatacatgtgccgtgttggtgtgctgcatgcattaactcgtcatttaacattaggtatatctcctaatgctatccctccccccaccacccaccccacagcaggccccgg

SEQ ID NO: 9856 - DNA, 6422 bp, Homo sapiens
  misc_feature (581)..(581): n is a, c, g, or t
  misc_feature (622)..(623): n is a, c, g, or t
  misc_feature (653)..(654): n is a, c, g, or t
  misc_feature (682)..(682): n is a, c, g, or t
  misc_feature (2575)..(2575): n is a, c, g, or t
atcctcagaattcctcgggtccctcgatactcggctgaaaattctcatcggactctgagaggagcgctgggctggaggcattttccccagggacagaagcgggctattctctcacttgggccagtaagaaaaatccaaaaaaagttgtcgactctgccagcagggattggctaacgggccgttattttcttgactccaccaaggcggatgaaggggaggctacggctgaggccgggaacagtggcgaatctgcagcctctcagaatttggcagtgcaaggaagggacggggaagagaagcaaagcggcgcgcatcctgtccagcgattcgccccgcccgcccggtgaatctgcgtctgcagaacgcgccactgaaggttccccagcgctggctggcctcctcccctccgccccgccccttttcctcagggactagtcgcagctttcgtcgccgccgattcgtcaaggtcccgggccgcagcatctagatcgtcgtggcgaacgactctccgggggatgcggccaatctccaagctccctgggccgcaacttccgagcctcccagggcgccggccgaggaancgctaccctcggccccgtgggtcccccggcagcgctgtggnnaagtgcgaatgagaccctgtgcccgctggnnctcgcgcagtgtaaatgagcaaagatgnatcaggaaggtgggggagatggcagaaggccccgagcttccagtggcggaactacaagctcatcgtggatcctgccttggaccctgccctgcgcaggccttctcagaaggtgtaccgctatgatggagtccacttcagtgtcaacgactcaaagtatataccagtcgaagacctccaagacccccgttgccatgtcaggtccaaaaacagagacttttccctcccagtccctaagtttaagctggacgagttctatattggacagattccactgaaggaagtgacttttgcaaggctgaatgacaacgtgcgggagaccttcctgaaggatatgtgccgtaagtacggtgaggtggaagaggtagagatctccttcacccccgtacgcgcaagcacctgggcctggcccgtgtgctcttcaccagcactcggggcgccaaggaaacggtcaagaacctccaccttacctccgtcatgggcaacatcatccatgcccagcttgacatcaaaggacaacaacgaatgaaatactatgaactaattgtcaatggctcctacacccctcagactgtgcccactgggggcaaggccctgagtgagaagttccaaggctcgggtgcagccactgagacggccgaatcccgccgccgctcttcctctgacacagctgcctacccagcaggcaccactgcggtgggcactcctggcaacggcaccccctgctcccaggacacaagcttctccagcagccgacaagataccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccactgcctcatcctccgcctcttcctcctcattgtcctcgtcctcctcgtcatcctcttcctcctcgtcctctcagtttcgtagttctgatgcaaactacccagcgtattatgaaagctggaatcgctaccagcgccatacttcctacccaccacgccgggcacacgggaggaaccccctggagccccttttgctgaaaatacagctgagcgcttcccaccttcttacactcctaactggcccccgagcccagcggccacgacaggatacggctcctgctcagaggtcaccccggagctccagaactggtggaggcgggggtggaggagggcccagccctgagagagaagaagttcggacttccccccgcccagcctcccctgcccgctctggctccccagccccggagaccaccaatgagagtgtgcccttcgcccagcacagcagcctggattcccgcatcgagatgctgctgaaggagcagcgctccaagttttccttcttggcctctgacacagaggaggaggaagagaacagcagcatggtccttggggccagagatacagggagtgaggtgccttctgggtcagggcatgggccctgcacaccccctccggccccagctaattttgaggatgtggcacctacagggagcggggagccaggggctacccgggagtctcccaaggcaaatggacagaaccaggcttctccatgctcttctggagacgacatggagatctccgacgacgaccggggtggctcaccccctccggccccgacgccccctcagcagctccgccacctccccctcccccgccgcctcctcctccctacctggcgtcccttcctcttggttatcctccccaccaacctgcctacctcctcccacccagacctnatgggccgccgccccctgagtaccccccacctcctccaccacccccgcacatctatgactttgtgaactccttggagctcatggaccgacttggggctcagtggggagggatgcccatgtccttccagatgcagacccagatgttaactcggctccatcagctgcggcagggcaagggattgattgccgcctcagctggcccccccggtggggcctttggggaggccttcctcccgtttccacccccgcaggaggcagcctacggcttgccgtatgctctatatgcacaggggcaggagggcagaggggcatactcacgggaggcctaccacctgcccatgccaatggcagccgagcccctgccctcctcctcagtctcgggagaggaggcccggctgccacccagggaagaagcagagctggcagagggcaagaccctcccgacagcaggcaccgtgggccgtgtgctcgccatgctggtccaggagatgaagagcatcatgcagcgagacctcaaccgcaagatggtggagaacgtggccttcggagcctttgaccagtggtgggagagcaaggaggagaaggccaagccattccagaacgcggccaagcagcaagccaaggaggaggataaagagaagacgaagctgaaggagcctggcctgctgtccctcgtggactgggccaagagcgggggcactacgggcatcgaggctttcgcctttgggtcagggctgagaggggccctgcggctgccttcattcaaggtaaagcggaaagagccatcggaaatttccgaggccagtgaggaaaagaggcctcgtccctccactcctgctgaggaagatgaagacgaccctgaacaagagaaggaggctggagagccaggacgtccggggaccaagcccccgaagcgggacgaagagcgaggcaagacccagggcaagcaccgcaagtcctttgctctggacagcgaaggggaggaggcatcccaggagtcctcctcggagaaggatgaggaggatgacgaggaagatgaggaagatgaagatcgagaggaagctgtggataccacaaagaaggagacagaggtgtcggatggcgaggacgaggaaagcgattcgtcttccaaatgttctctgtatgctgactcagatggcgaaaatgacagcacatcagactccgagagcagcagctcttccagctcctcatcctcctcctcctcctcgtcctcatcctcctcgtcctcttcatcctctgagtcctcctctgaagatgaagaggaagaggagcggccagcagcccttccctcagcctccccgccccccagagaagtcccagtgcccacgccagcacctgtggaggtgccagtgccggaaagggttgcaggctccccagtcacacccctgcccgaacaggaggcgtctccagcaaggcctgcaggccccacggaggagtcaccccccagtgcgcctctgcgtcccccagaaccacctgctgggcccccggcccctgccccacgccccgatgagcgtccctcttctcccatccccctcctgcccccacccaagaaacgccggaaaactgtctccttctctgccatcgaggtggtgccagccccggagccccctccagccacaccgccgcaggccaagtttcccggcccagcctcccgcaaggctccccggggcgtggagcggaccatccgcaacctgcccctggaccacgcatctctggtcaagagttggcccgaggaggtgtcccgaggaggccggagccgggctggaggccgaggccgcctcaccgaggaagaggaggctgagccagggacagaggtggacctggcggtcctggccgacctggccctgacccctgcccggcgcgggctgcctgccctgcctgctgttgaagactcagaggccacagagacatcggacgaggccgagcgccctaggcccctgctcagccacatcctcctggagcacaactatgccctggccgtcaagcccacgccccctgcgccagccctgcggcccccggagccagtgcccgcacccgccgccctcttcagttccccagctgatgaggtcctggaggcccccgaggtggtggtggctgaggcggaggagcccaagccgcagcaactgcagcagcagcgggaggagggcgaagaggagggggaggaagagggggaggaagaggaggaggagtcctctgacagcagcagcagcagcgatggggagggcgccctccggaggcgcagcctccgctcccacgcccggcgccgccgccctccgcccccacccccgccgccaccgccccgcgcctacgagccacgcagtgagtttgaacagatgaccatcctgtatgacatttggaactcgggcctggactcagaggacatgagttacctgcggcttacgtacgagcggctgctgcagcagacaagcggggctgactggctcaacgacactcactgggtccatcacacaatcaccaacctgaccaccccaaaacgcaagcggcggccccaggatgggccccgggagcaccagacaggctcagcccgcagcgaaggctactaccccatcagcaagaaggagaaggacaagtacctggacgtgtgcccagtctcggcccggcagctggagggcgtggacactcaggggacgaaccgcgtgctgtccgagcgccggtccgagcagcggcggctgctgagcgccatcggtacctccgccatcatggacagtgacctgctgaaactcaaccagctcaagttccggaagaagaagctccgatttggccggagccggatccacgagtggggtctgtttgccatggaacccattgctgctgacgagatggtcatcgaatacgtgggtcagaacatccgtcagatggtggccgacatgcgggagaagcgctacgtgcaggagggcattggcagcagctacctgttccgggtggaccacgacaccatcatcgatgccaccaagtgtggcaacctggccagattcatcaaccactgctgcacgcctaactgctacgccaaggtcatcaccatcgagtcccagaagaagatcgtgatctactccaagcagcccattggcgtggacgaggagatcacctacgactacaagttcccactggaagacaacaagatcccgtgtctgtgtggcacagagagctgccggggctccctaaactgaggtggggcaggatgggtgcccacacccctatttattccccctggtgccctgagctcccagcacccccccagccttagtgggctcagcagggcccacatgcccccatctccaagcgtggggttgggggccccaagcccagcgagggagcctcagtccctggaggcagcttctgcctctcctgtcgcccctgcccaccaccccctgattgtttttctttgcggagaagaagctgtaaatgttttgtagcagccagcagctgtttcctgtggaaacctggggtgccggcctgtacagattctgtcctggggggctacacagtcctctcgctttgtgttaatggggacttccccttacgccctgcgtgtacccctccccagtttaggggtctctggggcagtggccatgttctccccctgggggggctctgcacccccagtcctggggactccgtgcctggaaccctgcctcatctgttcctgccagaccctgagggtcacccttccaccctggtgtcactccccggctcagccaggccaggatggcggggtgggtcccttttgctgggctggactgtacatatgttaatagcgcaaacccgacgccacatttttataattgtgattaaactttattgtaca

SEQ ID NO: 9857 - DNA, 6151 bp, Homo sapiens
  misc_feature (581)..(581): n is a, c, g, or t
  misc_feature (622)..(623): n is a, c, g, or t
  misc_feature (653)..(654): n is a, c, g, or t
  misc_feature (682)..(682): n is a, c, g, or t
  misc_feature (2575)..(2575): n is a, c, g, or t
atcctcagaattcctcgggtccctcgatactcggctgaaaattctcatcggactctgagaggagcgctgggctggaggcattttccccagggacagaagcgggctattctctcacttgggccagtaagaaaaatccaaaaaaagttgtcgactctgccagcagggattggctaacgggccgttattttcttgactccaccaaggcggatgaaggggaggctacggctgaggccgggaacagtggcgaatctgcagcctctcagaatttggcagtgcaaggaagggacggggaagagaagcaaagcggcgcgcatcctgtccagcgattcgccccgcccgcccggtgaatctgcgtctgcagaacgcgccactgaaggttccccagcgctggctggcctcctcccctccgccccgccccttttcctcagggactagtcgcagctttcgtcgccgccgattcgtcaaggtcccgggccgcagcatctagatcgtcgtggcgaacgactctccgggggatgcggccaatctccaagctccctgggccgcaacttccgagcctcccagggcgccggccgaggaancgctaccctcggccccgtgggtcccccggcagcgctgtggnnaagtgcgaatgagaccctgtgcccgctggnnctcgcgcagtgtaaatgagcaaagatgnatcaggaaggtgggggagatggcagaaggccccgagcttccagtggcggaactacaagctcatcgtggatcctgccttggaccctgccctgcgcaggccttctcagaaggtgtaccgctatgatggagtccacttcagtgtcaacgactcaaagtatataccagtcgaagacctccaagacccccgttgccatgtcaggtccaaaaacagagacttttccctcccagtccctaagtttaagctggacgagttctatattggacagattccactgaaggaagtgacttttgcaaggctgaatgacaacgtgcgggagaccttcctgaaggatatgtgccgtaagtacggtgaggtggaagaggtagagatctccttcacccccgtacgcgcaagcacctgggcctggcccgtgtgctcttcaccagcactcggggcgccaaggaaacggtcaagaacctccaccttacctccgtcatgggcaacatcatccatgcccagcttgacatcaaaggacaacaacgaatgaaatactatgaactaattgtcaatggctcctacacccctcagactgtgcccactgggggcaaggccctgagtgagaagttccaaggctcgggtgcagccactgagacggccgaatcccgccgccgctcttcctctgacacagctgcctacccagcaggcaccactgcggtgggcactcctggcaacggcaccccctgctcccaggacacaagcttctccagcagccgacaagataccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccactgcctcatcctccgcctcttcctcctcattgtcctcgtcctcctcgtcatcctcttcctcctcgtcctctcagtttcgtagttctgatgcaaactacccagcgtattatgaaagctggaatcgctaccagcgccatacttcctacccaccacgccgggcacacgggaggaaccccctggagccccttttgctgaaaatacagctgagcgcttcccaccttcttacactcctaactggcccccgagcccagcggccacgacaggatacggctcctgctcagaggtcaccccggagctccagaactggtggaggcgggggtggaggagggcccagccctgagagagaagaagttcggacttccccccgcccagcctcccctgcccgctctggctccccagccccggagaccaccaatgagagtgtgcccttcgcccagcacagcagcctggattcccgcatcgagatgctgctgaaggagcagcgctccaagttttccttcttggcctctgacacagaggaggaggaagagaacagcagcatggtccttggggccagagatacagggagtgaggtgccttctgggtcagggcatgggccctgcacaccccctccggccccagctaattttgaggatgtggcacctacagggagcggggagccaggggctacccgggagtctcccaaggcaaatggacagaaccaggcttctccatgctcttctggagacgacatggagatctccgacgacgaccggggtggctcaccccctccggccccgacgccccctcagcagctccgccacctccccctcccccgccgcctcctcctccctacctggcgtcccttcctcttggttatcctccccaccaacctgcctacctcctcccacccagacctnatgggccgccgccccctgagtaccccccacctcctccaccacccccgcacatctatgactttgtgaactccttggagctcatggaccgacttggggctcagtggggagggatgcccatgtccttccagatgcagacccagatgttaactcggctccatcagctgcggcagggcaagggattgattgccgcctcagctggcccccccggtggggcctttggggaggccttcctcccgtttccacccccgcaggaggcagcctacggcttgccgtatgctctatatgcacaggggcaggagggcagaggggcatactcacgggaggcctaccacctgcccatgccaatggcagccgagcccctgccctcctcctcagtctcgggagaggaggcccggctgccacccagggaagaagcagagctggcagagggcaagaccctcccgacagcaggcaccgtgggccgtgtgctcgccatgctggtccaggagatgaagagcatcatgcagcgagacctcaaccgcaagatggtggagaacgtggccttcggagcctttgaccagtggtgggagagcaaggaggagaaggccaagccattccagaacgcggccaagcagcaagccaaggaggaggataaagagaagacgaagctgaaggagcctggcctgctgtccctcgtggactgggccaagagcgggggcactacgggcatcgaggctttcgcctttgggtcagggctgagaggggccctgcggctgccttcattcaaggtaaagcggaaagagccatcggaaatttccgaggccagtgaggaaaagaggcctcgtccctccactcctgctgaggaagatgaagacgaccctgaacaagagaaggaggctggagagccaggacgtccggggaccaagcccccgaagcgggacgaagagcgaggcaagacccagggcaagcaccgcaagtcctttgctctggacagcgaaggggaggaggcatcccaggagtcctcctcggagaaggatgaggaggatgacgaggaagatgaggaagatgaagatcgagaggaagctgtggataccacaaagaaggagacagaggtgtcggatggcgaggacgaggaaagcgattcgtcttccaaatgttctctgtatgctgactcagatggcgaaaatgacagcacatcagactccgagagcagcagctcttccagctcctcatcctcctcctcctcctcgtcctcatcctcctcgtcctcttcatcctctgagtcctcctctgaagatgaagaggaagaggagcggccagcagcccttccctcagcctccccgccccccagagaagtcccagtgcccacgccagcacctgtggaggtgccagtgccggaaagggttgcaggctccccagtcacacccctgcccgaacaggaggcgtctccagcaaggcctgcaggccccacggaggagtcaccccccagtgcgcctctgcgtcccccagaaccacctgctgggcccccggcccctgccccacgccccgatgagcgtccctcttctcccatccccctcctgcccccacccaagaaacgccggaaaactgtctccttctctgccatcgaggtggtgccagccccggagccccctccagccacaccgccgcaggccaagtttcccggcccagcctcccgcaaggctccccggggcgtggagcggaccatccgcaacctgcccctggaccacgcatctctggtcaagagttggcccgaggaggtgtcccgaggaggccggagccgggctggaggccgaggccgcctcaccgaggaagaggaggctgagccagggacagaggtggacctggcggtcctggccgacctggccctgacccctgcccggcgcgggctgcctgccctgcctgctgttgaagactcagaggccacagagacatcggacgaggccgagcgccctaggcccctgctcagccacatcctcctggagcacaactatgccctggccgtcaagcccacgccccctgcgccagccctgcggcccccggagccagtgcccgcgcctacgagccacgcagtgagtttgaacagatgaccatcctgtatgacatttggaactcgggcctggactcagaggacatgagttacctgcggcttacgtacgagcggctgctgcagcagacaagcggggctgactggctcaacgacactcactgggtccatcacacaatcaccaacctgaccaccccaaaacgcaagcggcggccccaggatgggccccgggagcaccagacaggctcagcccgcagcgaaggctactaccccatcagcaagaaggagaaggacaagtacctggacgtgtgcccagtctcggcccggcagctggagggcgtggacactcaggggacgaaccgcgtgctgtccgagcgccggtccgagcagcggcggctgctgagcgccatcggtacctccgccatcatggacagtgacctgctgaaactcaaccagctcaagttccggaagaagaagctccgatttggccggagccggatccacgagtggggtctgtttgccatggaacccattgctgctgacgagatggtcatcgaatacgtgggtcagaacatccgtcagatggtggccgacatgcgggagaagcgctacgtgcaggagggcattggcagcagctacctgttccgggtggaccacgacaccatcatcgatgccaccaagtgtggcaacctggccagattcatcaaccactgctgcacgcctaactgctacgccaaggtcatcaccatcgagtcccagaagaagatcgtgatctactccaagcagcccattggcgtggacgaggagatcacctacgactacaagttcccactggaagacaacaagatcccgtgtctgtgtggcacagagagctgccggggctccctaaactgaggtggggcaggatgggtgcccacacccctatttattccccctggtgccctgagctcccagcacccccccagccttagtgggctcagcagggcccacatgcccccatctccaagcgtggggttgggggccccaagcccagcgagggagcctcagtccctggaggcagcttctgcctctcctgtcgcccctgcccaccaccccctgattgtttttctttgcggagaagaagctgtaaatgttttgtagcagccagcagctgtttcctgtggaaacctggggtgccggcctgtacagattctgtcctggggggctacacagtcctctcgctttgtgttaatggggacttccccttacgccctgcgtgtacccctccccagtttaggggtctctggggcagtggccatgttctccccctgggggggctctgcacccccagtcctggggactccgtgcctggaaccctgcctcatctgttcctgccagaccctgagggtcacccttccaccctggtgtcactccccggctcagccaggccaggatggcggggtgggtcccttttgctgggctggactgtacatatgttaatagcgcaaacccgacgccacatttttataattgtgattaaactttattgtaca

SEQ ID NO: 9858 - DNA, 3201 bp, Homo sapiens
tgcgggaactagtcgcgagtgaacacctcagaaacaccttgtgaggaaagaaacatggtatttaaaaaccatgagatttcacacaaaaacccaaatttctggcttgagtgcagtggcacgatgtaatctccgcctcccgggttcaagcgattctcctgcctcagcctcccgagtagctggggttacaggcacccgccaccacgcctggctaatttttgtatttttagtagagctggggtttcactgtgttggccaggctggtcttgaactcctaacctcaggtgatctacctgccttggcctcccaaagtgctgggattacaggagtgagccaccgtgctctgcctgagtgtttgagctctaaacaggccccatcttttccccatcccccaggtaaagcggaaagagccatcggaaatttccgaggccagtgaggaaaagaggcctcgtccctccactcctgctgaggaagatgaagacgaccctgaacaagagaaggaggctggagagccaggacgtccggggaccaagcccccgaagcgggacgaagagcgaggcaagacccagggcaagcaccgcaagtcctttgctctggacagcgaaggggaggaggcatcccaggagtcctcctcggagaaggatgaggaggatgacgaggaagatgaggaagatgaagatcgagaggaagctgtggataccacaaagaaggagacagaggtgtcggatggcgaggacgaggaaagcgattcgtcttccaaatgttctctgtatgctgactcagatggcgaaaatgacagcacatcagactccgagagcagcagctcttccagctcctcatcctcctcctcctcctcgtcctcatcctcctcgtcctcttcatcctctgagtcctcctctgaagatgaagaggaagaggagcggccagcagcccttccctcagcctccccgccccccagagaagtcccagtgcccacgccagcacctgtggaggtgccagtgccggaaagggttgcaggctccccagtcacacccctgcccgaacaggaggcgtctccagcaaggcctgcaggccccacggaggagtcaccccccagtgcgcctctgcgtcccccagaaccacctgctgggcccccggcccctgccccacgccccgatgagcgtccctcttctcccatccccctcctgcccccacccaagaaacgccggaaaactgtctccttctctgccatcgaggtggtgccagccccggagccccctccagccacaccgccgcaggccaagtttcccggcccagcctcccgcaaggctccccggggcgtggagcggaccatccgcaacctgcccctggaccacgcatctctggtcaagagttggcccgaggaggtgtcccgaggaggccggagccgggctggaggccgaggccgcctcaccgaggaagaggaggctgagccagggacagaggtggacctggcggtcctggccgacctggccctgacccctgcccggcgcgggctgcctgccctgcctgctgttgaagactcagaggccacagagacatcggacgaggccgagcgccctaggcccctgctcagccacatcctcctggagcacaactatgccctggccgtcaagcccacgccccctgcgccagccctgcggcccccggagccagtgcccgcgcctacgagccacgcagtgagtttgaacagatgaccatcctgtatgacatttggaactcgggcctggactcagaggacatgagttacctgcggcttacgtacgagcggctgctgcagcagacaagcggggctgactggctcaacgacactcactgggtccatcacacaatcaccaacctgaccaccccaaaacgcaagcggcggccccaggatgggccccgggagcaccagacaggctcagcccgcagcgaaggctactaccccatcagcaagaaggagaaggacaagtacctggacgtgtgcccagtctcggcccggcagctggagggcgtggacactcaggggacgaaccgcgtgctgtccgagcgccggtccgagcagcggcggctgctgagcgccatcggtacctccgccatcatggacagtgacctgctgaaactcaaccagctcaagttccggaagaagaagctccgatttggccggagccggatccacgagtggggtctgtttgccatggaacccattgctgctgacgagatggtcatcgaatacgtgggtcagaacatccgtcagatggtggccgacatgcgggagaagcgctacgtgcaggagggcattggcagcagctacctgttccgggtggaccacgacaccatcatcgatgccaccaagtgtggcaacctggccagattcatcaaccactgctgcacgcctaactgctacgccaaggtcatcaccatcgagtcccagaagaagatcgtgatctactccaagcagcccattggcgtggacgaggagatcacctacgactacaagttcccactggaagacaacaagatcccgtgtctgtgtggcacagagagctgccggggctccctaaactgaggtggggcaggatgggtgcccacacccctatttattccccctggtgccctgagctcccagcacccccccagccttagtgggctcagcagggcccacatgcccccatctccaagcgtggggttgggggccccaagcccagcgagggagcctcagtccctggaggcagcttctgcctctcctgtcgcccctgcccaccaccccctgattgtttttctttgcggagaagaagctgtaaatgttttgtagcagccagcagctgtttcctgtggaaacctggggtgccggcctgtacagattctgtcctggggggctacacagtcctctcgctttgtgttaatggggacttccccttacgccctgcgtgtacccctccccagtttaggggtctctggggcagtggccatgttctccccctgggggggctctgcacccccagtcctggggactccgtgcctggaaccctgcctcatctgttcctgccagaccctgagggtcacccttccaccctggtgtcactccccggctcagccaggccaggatggcggggtgggtcccttttgctgggctggactgtacatatgttaatagcgcaaacccgacgccacatttttataattgtgattaaactttattgtaca

SEQ ID NO: 9859 - DNA, 255 bp, Homo sapiens
atgcccagcttgacatcaaaggtgaggactcctctgcctgccactcaggcttggcctccagcggaggttgtacatgcaaatgcctgtcagggtcaggcaggcgcccagggtcatgatctgaaactgctggggccagttgtgtttctgaaatcagatcagattttagagtggaattatggtacatggatttttgtgtgtgtggtgtctccagcaaggtcgggcaataggccataatcaagcacataactatctgta

SEQ ID NO: 9860 - DNA, 6608 bp, Homo sapiens
  misc_feature (581)..(581): n is a, c, g, or t
  misc_feature (622)..(623): n is a, c, g, or t
  misc_feature (653)..(654): n is a, c, g, or t
  misc_feature (682)..(682): n is a, c, g, or t
  misc_feature (2575)..(2575): n is a, c, g, or t
atcctcagaattcctcgggtccctcgatactcggctgaaaattctcatcggactctgagaggagcgctgggctggaggcattttccccagggacagaagcgggctattctctcacttgggccagtaagaaaaatccaaaaaaagttgtcgactctgccagcagggattggctaacgggccgttattttcttgactccaccaaggcggatgaaggggaggctacggctgaggccgggaacagtggcgaatctgcagcctctcagaatttggcagtgcaaggaagggacggggaagagaagcaaagcggcgcgcatcctgtccagcgattcgccccgcccgcccggtgaatctgcgtctgcagaacgcgccactgaaggttccccagcgctggctggcctcctcccctccgccccgccccttttcctcagggactagtcgcagctttcgtcgccgccgattcgtcaaggtcccgggccgcagcatctagatcgtcgtggcgaacgactctccgggggatgcggccaatctccaagctccctgggccgcaacttccgagcctcccagggcgccggccgaggaancgctaccctcggccccgtgggtcccccggcagcgctgtggnnaagtgcgaatgagaccctgtgcccgctggnnctcgcgcagtgtaaatgagcaaagatgnatcaggaaggtgggggagatggcagaaggccccgagcttccagtggcggaactacaagctcatcgtggatcctgccttggaccctgccctgcgcaggccttctcagaaggtgtaccgctatgatggagtccacttcagtgtcaacgactcaaagtatataccagtcgaagacctccaagacccccgttgccatgtcaggtccaaaaacagagacttttccctcccagtccctaagtttaagctggacgagttctatattggacagattccactgaaggaagtgacttttgcaaggctgaatgacaacgtgcgggagaccttcctgaaggatatgtgccgtaagtacggtgaggtggaagaggtagagatctccttcacccccgtacgcgcaagcacctgggcctggcccgtgtgctcttcaccagcactcggggcgccaaggaaacggtcaagaacctccaccttacctccgtcatgggcaacatcatccatgcccagcttgacatcaaaggacaacaacgaatgaaatactatgaactaattgtcaatggctcctacacccctcagactgtgcccactgggggcaaggccctgagtgagaagttccaaggctcgggtgcagccactgagacggccgaatcccgccgccgctcttcctctgacacagctgcctacccagcaggcaccactgcggtgggcactcctggcaacggcaccccctgctcccaggacacaagcttctccagcagccgacaagataccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccactgcctcatcctccgcctcttcctcctcattgtcctcgtcctcctcgtcatcctcttcctcctcgtcctctcagtttcgtagttctgatgcaaactacccagcgtattatgaaagctggaatcgctaccagcgccatacttcctacccaccacgccgggcacacgggaggaaccccctggagccccttttgctgaaaatacagctgagcgcttcccaccttcttacactcctaactggcccccgagcccagcggccacgacaggatacggctcctgctcagaggtcaccccggagctccagaactggtggaggcgggggtggaggagggcccagccctgagagagaagaagttcggacttccccccgcccagcctcccctgcccgctctggctccccagccccggagaccaccaatgagagtgtgcccttcgcccagcacagcagcctggattcccgcatcgagatgctgctgaaggagcagcgctccaagttttccttcttggcctctgacacagaggaggaggaagagaacagcagcatggtccttggggccagagatacagggagtgaggtgccttctgggtcagggcatgggccctgcacaccccctccggccccagctaattttgaggatgtggcacctacagggagcggggagccaggggctacccgggagtctcccaaggcaaatggacagaaccaggcttctccatgctcttctggagacgacatggagatctccgacgacgaccggggtggctcaccccctccggccccgacgccccctcagcagctccgccacctccccctcccccgccgcctcctcctccctacctggcgtcccttcctcttggttatcctccccaccaacctgcctacctcctcccacccagacctnatgggccgccgccccctgagtaccccccacctcctccaccacccccgcacatctatgactttgtgaactccttggagctcatggaccgacttggggctcagtggggagggatgcccatgtccttccagatgcagacccagatgttaactcggctccatcagctgcggcagggcaagggattgattgccgcctcagctggcccccccggtggggcctttggggaggccttcctcccgtttccacccccgcaggaggcagcctacggcttgccgtatgctctatatgcacaggggcaggagggcagaggggcatactcacgggaggcctaccacctgcccatgccaatggcagccgagcccctgccctcctcctcagtctcgggagaggaggcccggctgccacccagggaagaagcagagctggcagagggcaagaccctcccgacagcaggcaccgtgggccgtgtgctcgccatgctggtccaggagatgaagagcatcatgcagcgagacctcaaccgcaagatggtggagaacgtggccttcggagcctttgaccagtggtgggagagcaaggaggagaaggccaagccattccagaacgcggccaagcagcaagccaaggaggaggataaagagaagacgaagctgaaggagcctggcctgctgtccctcgtggactgggccaagagcgggggcactacgggcatcgaggctttcgcctttgggtcagggctgagaggggccctgcggctgccttcattcaaggtaaagcggaaagagccatcggaaatttccgaggccagtgaggaaaagaggcctcgtccctccactcctgctgaggaagatgaagacgaccctgaacaagagaaggaggctggagagccaggacgtccggggaccaagcccccgaagcgggacgaagagcgaggcaagacccagggcaagcaccgcaagtcctttgctctggacagcgaaggggaggaggcatcccaggagtcctcctcggagaaggatgaggaggatgacgaggaagatgaggaagatgaagatcgagaggaagctgtggataccacaaagaaggagacagaggtgtcggatggcgaggacgaggaaagcgattcgtcttccaaatgttctctgtatgctgactcagatggcgaaaatgacagcacatcagactccgagagcagcagctcttccagctcctcatcctcctcctcctcctcgtcctcatcctcctcgtcctcttcatcctctgagtcctcctctgaagatgaagaggaagaggagcggccagcagcccttccctcagcctccccgccccccagagaagtcccagtgcccacgccagcacctgtggaggtgccagtgccggaaagggttgcaggctccccagtcacacccctgcccgaacaggaggcgtctccagcaaggcctgcaggccccacggaggagtcaccccccagtgcgcctctgcgtcccccagaaccacctgctgggcccccggcccctgccccacgccccgatgagcgtccctcttctcccatccccctcctgcccccacccaagaaacgccggaaaactgtctccttctctgccatcgaggtggtgccagccccggagccccctccagccacaccgccgcaggccaagtttcccggcccagcctcccgcaaggctccccggggcgtggagcggaccatccgcaacctgcccctggaccacgcatctctggtcaagagttggcccgaggaggtgtcccgaggaggccggagccgggctggaggccgaggccgcctcaccgaggaagaggaggctgagccagggacagaggtggacctggcggtcctggccgacctggccctgacccctgcccggcgcgggctgcctgccctgcctgctgttgaagactcagaggccacagagacatcggacgaggccgagcgccctaggcccctgctcagccacatcctcctggagcacaactatgccctggccgtcaagcccacgccccctgcgccagccctgcggcccccggagccagtgcccgcgcctacgagccacgcagtgagtttgaacagatgaccatcctgtatgacatttggaactcgggcctggactcagaggacatgagttacctgcggcttacgtacgagcggctgctgcagcagacaagcggggctgactggctcaacgacactcactgggtccatcacacaatcaccaacctgaccaccccaaaacgcaagcggcggccccaggatgggccccgggagcaccagacaggctcagcccgcagcgaaggctactaccccatcagcaagaaggagaaggacaagtacctggacgtgtgcccagtctcggcccggcagctggagggcgtggacactcaggggacgaaccgcgtgctgtccgagcgccggtccgagcagcggcggctgctgagcgccatcggtacctccgccatcatggacagtgacctgctgaaactcaaccagctcaagttccggaagaagaagctccgatttggccggagccggatccacgagtggggtctgtttgccatggaacccattgctgctgacgagatggtcatcgaatacgtgggtcagaacatccgtcagatggtggccgacatgcgggagaagcgctacgtgcaggagggcattggcagcagctacctgttccgggtggaccacgacaccatcatcgatgccaccaagtgtggcaacctggccagattcatcaaccactgctgcacgcctaactgctacgccaaggtcatcaccatcgagtcccagaagaagatcgtgatctactccaagcagcccattggcgtggacgaggagatcacctacgactacaagttcccactggaagacaacaagatcccgtgtctgtgtggcacagagagctgccggggctccctaaactgaggtggggcaggatgggtgcccacacccctatttattccccctggtgccctgagctcccagcacccccccagccttagtgggctcagcagggcccacatgcccccatctccaagcgtggggttgggggccccaagcccagcgagggagcctcagtccctggaggcagcttctgcctctcctgtcgcccctgcccaccaccccctgattgtttttctttgcggagaagaagctgtaaatgttttgtagcagccagcagctgtttcctgtggaaacctggggtgccggcctgtacagattctgtcctggggggctacacagtcctctcgctttgtgttaatggggacttccccttacgccctgcgtgtacccctccccagtttaggggtctctggggcagtggccatgttctccccctgggggggctctgcacccccagtcctggggactccgtgcctggaaccctgcctcatctgttcctgccagaccctgagggtcacccttccaccctggtgtcactccccggctcagccaggccaggatggcggggtgggtcccttttgctgggctggactgtacatatgttaatagcgcaaacccgacgccacatttttataattgtgattaaactttattgtacaaaagtgtttggtcggtgtatttgggcaggagcgaggggttgggggtagagggcacggagggttgtgcaagttgaagagagggaaaagtgggtacctgaagtgtggggcaggtaaagggcccttcaggcaagagcccagacctgcagagacagtccgagactgtctcggaccccctgacaggctgcagcagccgcacccgcaccaggaataccccaccagtgcccgccagggtggtgccaaggtcaggcctccccttcctacaatcacagctgcagctggacctccggcctcctgggaagcccagcaggagggaaggcctgaggtcacactgtgggatgaggtcaccgctggctccacccacagccccagaccccttcagcccactctgcaagttcgagcttcatccccaccaagttctccgctggacccagatgccagtggagcacagagcgccgcc

SEQ ID NO: 9861 - DNA, 741 bp, Homo sapiens
taaatatgttcatgattaatttgtaattttaaggagatggaatttgaaaatacctgagaatgttatggaatgttacagaattcggcttcataaattaagaaagatgtcctagctctgttagcttctattcataatggatataactacttaaactctttgaacttcaatttcaaagatacctcctgtctcaaaaagctgtgagaattggacacatttcagaagagtgctatgtgagctctaaagcattatattaaaaaagcctgttactttgtttttgttgttgttataatatttttatcccactcatcgtttgctggaaacggctccctttagatcaggaaggttgattttgtgcctttcaccactcgtaattcagtgacttgaaactggccatggcgggagtatttacacaaaggaagtcagtaaatattataaatcaggaccttggccgggcaccgtggctcatgcctatagtcccagcactttgggaggccgaggcgggcagatcacgaggttgggaaatcaagaccatcctggctaacacagtgaaaccctgtctctactaaacagaaaatgcaaagaattagccgggcgtggtggcacgtgcctgtggtcccagctactcgggaggctgaggcgggagaatcgtttgagcccgggagacagaggttgcagtgagctaagatcgtgccactgcactccagcctgggcgacagggcgagactctgtgtaaaaaaaaaa

SEQ ID NO: 9862 - DNA, 391 bp, Homo sapiens
aattgagatgtgctgtcaatgtgaaatgcacaatgtattttaaatagtctgaaaagtaaaatcttttacttagtacaaaagaaagtaatactttaaaaatagtgattggccgggcgcagtggctcaacacctgtaatcccagcactttgggaggccgaggcgggagatcatgaggtcaggagttcgagaccagcctgacgaacatggcaaaaccctgtctttactaaaaatataaaaatcagccaggcgtggtggcgcacgcctgtaatcccagctactggggaggctgaggcaggagaatcgcttgaacccgggaggcagaggttgcagtgagccaagatcacaccactgcactccagtctgggtgacagaacgagactctgtctcaaaa

SEQ ID NO: 9863 - DNA, 379 bp, Homo sapiens
aaaacatgttgtaagatcttcattattaaaatattaaaactcctatttatcaaattgtttttttattttcacagcctaagaaactaagttgtaaactatgtaaccatgtgggaaaagaagttatcattgaggaagtaaagagaaactaggaaatactggtttgtttccctttccaggaaaacattaaatagctgttgctatatgttatcccttttaacatcatctttctaaaagtgaaataactttatattgaataaaaatttatgaatttactcataaatagtgataacaattaggaatctacaagttgattttttaggtcaaaacaagaacaaccatccataatgctttgaggccttttcttgtattttgatgcagt

SEQ ID NO: 9864 - DNA, 189 bp, Homo sapiens
taataagtgcatactgagtaaagacatttcaaaatttattttttcaaaagcatcaaattatacattttgtagtaatcattgcagtgcataatggtaaagttgctgtcctttaataaataaacagttctggaagcacttagtgatgttttaaactcaatatttcttaatttcttccagtcacttttatgc

SEQ ID NO: 9865 - DNA, 224 bp, Homo sapiens
gtgaaaacgaagaagatatcacagtctgtccaggaaggaaacagaggagcaggtgaatgctcaggaaaccggattcgtagtatgcactaccccagaattggggctggcaaattctgctcttaaaacccccacctagagccaactgctgcccctaataatatgcccaaaatattaccaggacgaaggcctcatgcttcctggatgaaccacaaaaaaaaaggttg

SEQ ID NO: 9866 - DNA, 136 bp, Homo sapiens
tggggtctcactcatagctcactgcagcctcaatctccctggctcaagcaatcttcttgcctcagcttccacggtaactgggactacagataggcaccatgatacctggctaattcttttttatttttagtagaga

SEQ ID NO: 9867 - DNA, 503 bp, Homo sapiens
gacaattccaggtcacttcgatctgcctaatggactctttgagatttggccagtgaatttcatccagctacctccctatcaaggttataaaccatggtttgtgttttccgtttgggtagacgcactctcttgttgacaggccactacctcagcggtttcaaagctgttgttagaaaaggttatcctacatggggcaaaccctcagacttatatggtgactgaggaaatgcacctcactgggccatgaggaaagagcaaatttgccaagattggcccatatttcaaccctttccttgtgcttatctccaatcttccttattggcagaaagaacaaatggcattctcaaaacccaactggtgaaatttgaggaggcattacagctgccctgggacaaaggtacttgctctggtccttttgagtctaaggtatgcactttttggaaaacataactcgtcaccttttgaaattattactggatggccaatacatttagcccactctg

SEQ ID NO: 9868 - DNA, 295 bp, Homo sapiens
aacagcctccacccactcacttgatctgacttcctaataatacactctttggatcaaggtggggaataagtggagaagcattgaatcgctcattcgattctcacagagactgtagcaaggcaggacaaggtctaactgaatacactcagattctcctatttcccattgttttccattaaaagaaaaaaaggtataggtcattttatagtgagaataaacaacatgccacagtaagcgtttcacatattcgttcatgaatcagagaagctgcttcccgtgtgtgtcattgtctaaa

SEQ ID NO: 9869 - DNA, 320 bp, Homo sapiens
gtcccagggattaaggcatgaatgtctttggaggggatattatcctgcctaccataatactgcttttctttctccttataatagggatactgtgattttcctgacccacctcacagggctattatgagaatcaaatgcagtaatggacataaaaatgtttttacaaatggtaagagtcaatagatgtagaaggagttttatccttcttttactatggagagacagagggttcagagtaaaagaagcatcatggaatgaaacaataggaaaaaggtactaagagtaaaggttaaagggggaggttgtgtttaacctaaagg

SEQ ID NO: 9870 - DNA, 407 bp, Homo sapiens
cttcaccatctttcatgggacaaatgcttccagaatgaatgaataaatgaaggggagggcaagggtcttccaaggaaaggacctctgagttcagcctaggcgacagctacacactgtctgccggtggacacccaactctctatcttccccgaaatctgctcggctagttgtgctacctctctgtgcctcagcttcctcacctgtggaagggggacagtgccagctatctctcagatcgtggtggctggggtgccatgtgctctgccactccttgactgtaaggcctcaggccagcctcttcatctacccacctctgcctcctcgtccatcacacggatcggaaacaggacgtactgcttatcagctgctatgcaataaattgtgttccctaaaaggtatgttgaagc

SEQ ID NO: 9871 - DNA, 143 bp, Homo sapiens
taaatgattgattgttccatagaatatgaagagacattaaataaatcttaaaatatttataaagttttggttaaaatgagcacaatttcttctcaaaaaaattcactgccagcctgggcaacatagggagacactgtctctac

SEQ ID NO: 9872 - DNA, 710 bp, Homo sapiens
acagagtctgttacaaacgtaatatccaattgcagtgagatggaactgaagacttacaaagcagaggcacacttcctatgagacaggggccttgccacaaacgacacgtctggcttcttgagcagtttcactcagactatttaggagcccatcagaatattcagtggcagaacaaggtcagtaatggcaaacactcagaatgcagcctgtgtaagagctttgaaccaattcttccacaatacagctttactgagcgggatttgtgtggagaatggactacagcaggactcctaggcggccattgaatcgcaagctgaggtggggaaagcgcaagctgaggaggcagaaggaatgttgtctgagacctgctgcagtgcaccctgagcagtgaggtcacagcaggcccagccatgggcaagcagcctggcatccagctgggagggatgggattgctgttggtgagcagaggctctggctagctcttgagtctaaaaagcaggaccacaaagaaaacagactatttaaatagcaggtgaagccgcttacaaaagagcaaacttgatgcaaattctgtgtggaaaagattgttggtctcattttattgtctttggccatacccataaatctgactcaggaaagacatttatatgtacacaagtgtatacaaataaaagtaaagttttactctattactttccaccccttcatcc

SEQ ID NO: 9873 - DNA, 601 bp, Homo sapiens
acccgcttgggcagcgacagctgttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccgggtaccttgttatcccataactttggtatcctgaaatctgaggattccaccaagataatatgataagaactttcagtgatttggggccatatcctacttagactaatgtggaatttccagatttcctgagagcttggtacagcagcacacactgcttgctaatcagcacaggcaataatgccatctctgcctcaagaaggagttattcagggaccctctcccctggatttgaatacagaattaccttatcaaagcacaatgaaaaggaaagtcagaaagaagaaaaagaagggaaccattacagcaaatgttgccgggacaaagtttgaaattggtaggtttccttagaagcaatcatgggattctcataattgctgg

SEQ ID NO: 9874 - DNA, 862 bp, Homo sapiens
ataacttttttagataggttcttaatatgttgccttattacatttcagctcttactcacctgaatagcctgttttgttgctatccagttgtattggctctttgcatgaagcctgcatcttttgcagacttaagttttaacctctttctatctttagggaagaatcaatagaaaaacctcttctggttgggcgtggtggctgacacctgtaatcccagcattttgggaggccaaggcgggtggatcacgaggtcaagagattgagaccttccctggccaacatagtgaaaccccatctctactaaaaatacaaaaattagctgggtatggtggcacacgcctgtagtcccagctactcaggaggctgaggcaggagaattgcttaaacccgggaggtggaggctacagtgagctgagattgggccactgcactacagcttggtgacagcgagactccatctcaaaaaacaaacaacaaccatcaaaaaaaaaaacaaaacaaaaaaaacacctcttcctaagatggtgctttaaagatgtagagtagattgcatagggagaccaggatgcagaaatacttgtgatgtcagctatatgtaatctggtttcattcttttatttttagaacataatacaaacttatattcagaagaaaatagacctcaaactaaaaagccaaatataaggaattctagagagttgacagtttgtatagaccttattcatttattagtttagaaggtaatataaaattgactgtagtgaacaaataagtcatttttgccagtgcttatgtctgtgaatatagtgaatctagaataacaaaagtaatttggatattgaattatcactattcaacctag

SEQ ID NO: 9875 - DNA, 3332 bp, Homo sapiens
acccgcttgggcagcgacagctgttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccgggtaccttgttatcccataactttggtatcctgaaatctgaggattccaccaagataatatgataagaactttcagtgatttggggccatatcctacttagactaatgtggaatttccagatttcctgagagcttggtacagcagcacacactgcttgctaatcagcacaggcaataatgccatctctgcctcaagaaggagttattcagggaccctctcccctggatttgaatacagaattaccttatcaaagcacaatgaaaaggaaagtcagaaagaagaaaaagaagggaaccattacagcaaatgttgccgggacaaagtttgaaattgttcgtttagtaatagatgaaatgggatttatgaaaactccagatgaggatgaaacaagtaatcttatatggtgtgattctgctgttcagcaggagaaaatttcagagctgcaaaattatcagaggatcaaccattttccaggaatgggggagatctgtaggaaggatttcttagcaagaaatatgaccaaaatgatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggatttctttgataagaaatggtgacaaacttccatctcaggatcatttgattgttcaagaatacattgaaaagcctttcctaatggaaggttacaagtttgacttacgaatttatattctggttacatcgtgtgatccactaaaaatatttctctaccatgatgggcttgtgcgaatgggtacagagaagtacattccacctaatgagtccaatttgacccagttatacatgcatctgacaaactactccgtgaacaagcataatgagcattttgaacgggatgaaactgagaacaaaggcagcaaacgttccatcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggatcctcttgggagagtatattcaataaaagcccggaggtggtgactcctttgcagctccagtgttgccagcgcctagtggagctttgtaaacagtgcctgctagtggtttacaaatatgcaactgacaaaagaggatcactttcaggcattggtcctgactggggtaattccaggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacaaaaaaaaa

SEQ ID NO: 9876 - DNA, 3147 bp, Homo sapiens
gctttgcgtgactgactctcttaatttccaccgctacacgtaccttgttatcccataactttggtatcctgaaatctgaggattccaccaagataatatgataagaactttcagtgatttggggccatatcctacttagactaatgtggaatttccagatttcctgagagcttggtacagcagcacacactgcttgctaatcagcacaggcaataatgccatctctgcctcaagaaggagttattcagggaccctctcccctggatttgaatacagaattaccttatcaaagcacaatgaaaaggaaagtcagaaagaagaaaaagaagggaaccattacagcaaatgttgccgggacaaagtttgaaattgttcgtttagtaatagatgaaatgggatttatgaaaactccagatgaggatgaaacaagtaatcttatatggtgtgattctgctgttcagcaggagaaaatttcagagctgcaaaattatcagaggatcaaccattttccaggaatgggggagatctgtaggaaggatttcttagcaagaaatatgaccaaaatgatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggatttctttgataagaaatggtgacaaacttccatctcaggatcatttgattgttcaagaatacattgaaaagcctttcctaatggaaggttacaagtttgacttacgaatttatattctggttacatcgtgtgatccactaaaaatatttctctaccatgatgggcttgtgcgaatgggtacagagaagtacattccacctaatgagtccaatttgacccagttatacatgcatctgacaaactactccgtgaacaagcataatgagcattttgaacgggatgaaactgagaacaaaggcagcaaacgttccatcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggatcctcttgggagagtatattcaataaaagcccggaggtggtgactcctttgcagctccagtgttgccagcgcctagtggagctttgtaaacagtgcctgctagtggtttacaaatatgcaactgacaaaagaggatcactttcaggcattggtcctgactggggtaattccaggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacaaaaaaaaa

SEQ ID NO: 9877 - DNA, 2851 bp, Homo sapiens
acccgcttgggcagcgacagctgttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccgggtaccttgttatcccataactttggtatcctgaaatctgaggattccaccaagataatatgataagaactttcagtgatttggggccatatcctacttagactaatgtggaatttccagatttcctgagagcttggtacagcagcacacactgcttgctaatcagcacaggcaataatgccatctctgcctcaagaaggagttattcagggaccctctcccctggatttgaatacagaattaccttatcaaagcacaatgaaaaggaaagtcagaaagaagaaaaagaagggaaccattacagcaaatgttgccgggacaaagtttgaaattgttcgtttagtaatagatgaaatgggatttatgaaaactccagatgaggatgaaacaagtaatcttatatggtgtgattctgctgttcagcaggagaaaatttcagagctgcaaaattatcagaggatcaaccattttccaggaatgggggagatctgtaggaaggatttcttagcaagaaatatgaccaaaatgatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggatttctttgataagaaatggtgacaaacttccatctcaggatcatttgattgttcaagaatacattgaaaagcctttcctaatggaaggttacaagtttgacttacgaatttatattctggttacatcgtgtgatccactaaaaatatttctctaccatgatgggcttgtgcgaatgggtacagagaagtacattccacctaatgagtccaatttgacccagttatacatgcatctgacaaactactccgtgaacaagcataatgagcattttgaacgggatgaaactgagaacaaaggcagcaaacgttccatcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaaatgaagatgttttcagtttgtatgatgatgagaatgatttagaagagaggaatggcccaggaaagagaggtgttaaaaagttcttgagtaagtaagctgtgagagggggagggttttcctaatcaagagcatttattctaacaggggggaaggcaggtgcatgggaatgtggtgggaagatgggaaagttttcttctggtggggagggcttctggagattggggagagagtctccgtcgaact

SEQ ID NO: 9878 - DNA, 3155 bp, Homo sapiens
acccgcttgggcagcgacagctgttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccgggtaccttgttatcccataactttggtatcctgaaatctgaggattccaccaagataatatgataagaactttcagtgatttggggccatatcctacttagactaatgtggaatttccagatttcctgagagcttggtacagcagcacacactgcttgctaatcagcacaggcaataatgccatctctgcctcaagaaggagttattcagggaccctctcccctggatttgaatacagaattaccttatcaaagcacaatgaaaaggaaagtcagaaagaagaaaaagaagggaaccattacagcaaatgttgccgggacaaagtttgaaattgttcgtttagtaatagatgaaatgggatttatgaaaactccagatgaggatgaaacaagtaatcttatatggtgtgattctgctgttcagcaggagaaaatttcagagctgcaaaattatcagaggatcaaccattttccaggaatgggggagatctgtaggaaggatttcttagcaagaaatatgaccaaaatgatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggatttctttgataagaaatggtgacaaacttccatctcaggatcatttgattgttcaagaatacattgaaaagcctttcctaatggaaggttacaagtttgacttacgaatttatattctggttacatcgtgtgatccactaaaaatatttctctaccatgatgggcttgtgcgaatgggtacagagaagtacattccacctaatgagtccaatttgacccagttatacatgcatctgacaaactactccgtgaacaagcataatgagcattttgaacgggatgaaactgagaacaaaggcagcaaacgttccatcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggtttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacaaaaaaaaa

SEQ ID NO: 9879 - DNA, 2566 bp, Homo sapiens
acccgcttgggcagcgacagctgttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccgggtaccttgttatcccataactttggtatcctgaaatctgaggattccaccaagataatatgataagaactttcagtgatttggggccatatcctacttagactaatgtggaatttccagatttcctgagagcttggtacagcagcacacactgcttgctaatcagcacaggcaataatgccatctctgcctcaagaaggagttattcagggaccctctcccctggatttgaatacagaattaccttatcaaagcacaatgaaaaggaaagtcagaaagaagaaaaagaagggaaccattacagcaaatgttgccgggacaaagtttgaaattgttcgtttagtaatagatgaaatgggatttatgaaaactccagatgaggatgaaacaagtaatcttatatggtgtgattctgctgttcagcaggagaaaatttcagagctgcaaaattatcagaggatcaaccattttccaggaatgggggagatctgtaggaaggatttcttagcaagaaatatgaccaaaatgatcaagtctcggcctctggattatacctttgttcctcgaacttggatctttcctgctgaatatactcaattccaaaattatgtgaaagaattgaagaaaaaacggaagcagaaaacttttatagtgaaaccagctaatggtgcaatgggtcatgggatttctttgataagaaatggtgacaaacttccatctcaggatcatttgattgttcaagaatacattgaaaagcctttcctaatggaaggttacaagtttgacttacgaatttatattctggttacatcgtgtgatccactaaaaatatttctctaccatgatgggcttgtgcgaatgggtacagagaagtacattccacctaatgagtccaatttgacccagttatacatgcatctgacaaactactccgtgaacaagcataatgagcattttgaacgggatgaaactgagaacaaaggcagcaaacgttccatcaaatggtttacagaattccttcaagcaaatcaacatgatgttgctaagttttggagtgatatttcagaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagtaagtcaatttcttctaatttagatgttatataaagaattatggaactgaaattattaaactcagtaaaaggtccttgggccaaatgaaccctgttgtgtgtgaggagacctggattccatcccacttccttccctaaccagactcgggcacatcccttaattaagccctttcaagatctgcaaatagaaaacgaaagggctggattaaggatctattctatatttcatcgtttttgttaggtgccagatttttgcctgggttttgtaaaatgtgcctcatggctgatctgatgattatgtgtctcttaagccaatatattctctctcattcaatttctgcctctctacttccttcacccactttgttttatactatca

SEQ ID NO: 9880 - DNA, 2109 bp, Homo sapiens
acccgcttgggcagcgacagctgttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccggattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggatcctcttgggagagtatattcaataaaagcccggaggtggtgactcctttgcagctccagtgttgccagcgcctagtggagctttgtaaacagtgcctgctagtggtttacaaatatgcaactgacaaaagaggatcactttcaggcattggtcctgactggggtaattccaggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacaaaaaaaaa

SEQ ID NO: 9881 - DNA, 2268 bp, Homo sapiens
acccgcttgggcagcgacagctgttccaggcactccgcgtcgagcaccggagtcccgagccgtggctgccacgggcggtgggcgggcggaggagagcaccggaccaccagtgcaggctgccgagtcggggcggccgcccacggggaagctgcgaggcgcgggagcacctgggggaccgcttgcagcggggacgcgaggacccgggctgggctttcctcacccgggaattggtggtaaagaccctgattgtagcagaacctcatgtcctgcatgcctatcgaatgtgtagacctggtcaacctccaggaagcgaaagtgtctgctttgaagtcctgggatttgatattttgttggatagaaaactaaagccatggcttctggagattaaccgagccccaagctttggaactgatcagaaaatagactatgatgtaaaaaggggagtgctgctaaatgcgttgaagctactaaacataaggaccagtgacaaaagaagaaacttggccaaacaaaaagctgaggctcaaaggaggctctatggtcaaaattcaattaaaaggctcttaccaggctcctcagactgggaacagcagagacaccagttggagaggcggaaagaagagttgaaagagagactcgctcaagtacgaaagcagatctcacgagaagaacatgaaaatcgacatatggggaattatagacgaatttatcctcctgaagataaagcattacttgaaaagtatgaaaatttgttagctgttgcctttcagaccttcctttcaggaagagcagcttcattccagcgagagttgaataatcctttgaaaaggatgaaggaagaagatattttggatcttctggagcaatgtgaaattgatgatgaaaagttgatgggaaaaactaccaagactcgaggaccaaagcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggatcctcttgggagagtatattcaataaaagcccggaggtggtgactcctttgcagctccagtgttgccagcgcctagtggagctttgtaaacagtgcctgctagtggtttacaaatatgcaactgacaaaagaggatcactttcaggcattggtcctgactggggtaattccaggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacaaaaaaaaa

SEQ ID NO: 9882 - DNA, 1393 bp, Homo sapiens
gaaggaaggcactactagcaagcctgattgtgccactctttcttctggcctctgtgttctatgcctgagagtactgagataatgaaaagaccaaagtactgcagcagtgacagcagttatgatagtagcagcagctcttcagaatctgacgaaaatgaaaaagaagagtaccaaaataagaaaagagaaaagcaagttacatataatcttaaaccctccaaccactacaaattaattcaacaacccagctccataagacgttcagtcagctgccctcggtccatctctgctcaatcaccttccagtggggacacccgcccattttctgctcaacaaatgatatctgtgtcacggccaacttctgcatctcggtcacattccttaaaccgtgcttcctcctacatgaggcatctgcctcacagtaatgatgcctgctctaccaactctcaagtgagtgagtctttgcggcaactgaaaacaaaagaacaagaagatgatctaacaagtcagaccttatttgttctcaaagacatgaagatccggtttccaggaaagtcagatgcagaatcagaacttctgatagaagatatcattgataactggaagtatcataaaaccaaagtggcttcatattggctcataaaattggactctgtaaaacaacgaaaagttttggacatagtgaaaacaagtattcgtacagttcttccacgcatctggaaggtgcctgatgttgaagaagtaaatttatatcggattttcaaccgggtttttaatcgcttactctggagtcgtggccaagggctgtggaactgtttctgtgattcaggatcctcttgggagagtatattcaataaaagcccggaggtggtgactcctttgcagctccagtgttgccagcgcctagtggagctttgtaaacagtgcctgctagtggtttacaaatatgcaactgacaaaagaggatcactttcaggcattggtcctgactggggtaattccaggtatttactaccagggagcacccaattcttcttgagaacaccaacctacaacttgaagtacaattcacctggaatgactcgctccaatgttttgtttacatccagatatggccatctgtgaaacagaagggaagatcgccattggttatacataacagcaattcatttttttcctctgaagttgaacatgcaaagaacatgaccattaagtgctgttttatgtatataagacatatatatgtgtgaaaatatatgcacatatgcaccctaataacatatatttattatattaaatgatatatgaaagaagaattagcagaaaatggaatataagacttaacctttctggaaacgtaataaaccatgttaaaattgtttacaaaaaaaaa

SEQ ID NO: 9883 - DNA, 1429 bp, Homo sapiens
aggctaggtagaggcggggttgcaggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggcggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagccacaagtgggatctgacctggtgagattatttctgatgacctcatcaaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaacgccgt

SEQ ID NO: 9884 - DNA, 1681 bp, Homo sapiens
gccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgttttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggcggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagccacaagtgggatctgacctggtgagattatttctgatgacctcatcaaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatcctttgcaggcagcctgctcccctgagcgctgggctggtgatggccgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaacgccgt

SEQ ID NO: 9885 - DNA, 318 bp, Homo sapiens
ccactctcactactcctattcaacacaatactggaagttctagccagagcaatcaggcaagagaaacaaataaaaggcatccacataggaaaagaagaagtcaaactacctctcttcacaggtaatattattctatacctacagaaccctaaagatcaacccaaacagctcctggaactgataaactacttcagtaatatttcaagatgtacaaaaatcagtagaatttctacacaccaataacgttcaagctgagagccaaaacaagaatgcaatcccatttacaatgccacacaaaaaaaatgaaactacctagga

SEQ ID NO: 9886 - DNA, 419 bp, Homo sapiens
gcaaccaaccattactgagcattctcgattttccaaggaaggtgctcatatatttttggtgaatcccatgaagcccatatttgtagcggacatatgctgtaatcccagaagcagaagggacctggtcctcctttctccactctccccacactgtggaagcttcagggcacagaggcgattgagagttgctcagcagcagtggtgctgagcatttagctctggccacaatatccggtggccagtgcagttgatgtcaacatcagtttcccaaccagaccaaccctgaggctttgccctgcatgactttccctgctccctgagctcccttaggttctgctaagcctggttctatagccttcccttctattgtgtgaattgtccaaaactgattcaataaattcctcttttgcctaagcaag

SEQ ID NO: 9887 - DNA, 1059 bp, Homo sapiens
gcactctggatatagttggtgttttcccattactgtattattaagcaaaatttagaatgaaatttttagggtactggctggtgattcaggatgcttgggatctagactttcattagcccctacctgcaagtttgctgatgggaggaaccttgtcttgttggtcatggtgtccctagtgctagcatggagtctgcacataatacttgttcacagagtaagtcagagctgaccaagttctctgttttctggagtagaggacttctatgtttcctgcaagctcagcacttccacctcctgtggctgcactaatacgaaatcagagaccactcgctgtacttcactttgaatcactcagtcaccaaaaagatagtgcttgccatgtgtcaggaacttggctaggcagggagaaattcatatgatttatataaatccataaatccatatgatttacataaatccataaattcatgtgatatatacgtatatgtgtgtgtatatatatattagagaatgtttgacatatacacaagtacatgttaccgacaccagcctatagaatagttttcgtgcatctccatatatctatcactggttccaacagccatcaatccatgttagctgccccatccaaatgccaccatcaccctcctcctgactatcatgttattttgaagcaatagcctgtaaatatttcagaatgctctccaaaatataaagactcctgtaaaaacatatgacaacaatgccattattactttctttgaatcaacattttttccttaatataatcaaatatttagaaatcaaatttgaataaaacatgggtcaatcttcaaagaatttatagcttaatggaacagatcaaggaaagcagggatgacactacagtagggtagcatcatatgcccatgtaacttatgtgacttaaactatcctgtaagggtgtgggggagaaagagaggaagagatggagagaagaaaaaggaagagaaggaggaggagaaggaggcagaggagaaggtggacggggaaggtagagaggaggaggaggggaattag

SEQ ID NO: 9888 - DNA, 3709 bp, Homo sapiens
  misc_feature (5)..(5): n is a, c, g, or t
cgcgncctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggatttcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctcta

SEQ ID NO: 9889 - DNA, 448 bp, Homo sapiens
atctagtaggatcccctaatctgtactcatttccctgagtgtctaaccgtgatgatcagagggtgtctgcctgcaggtctgactctgctggccactggatatccaccagtctgcctagacacaatgtgtatccattggtctgtctgtcttgatcagggcccaagtgttcctacacctctgagggctgctagagaactgaagggggttgagagaaagagccaagggcctggggcactgcaggtgtgtctgtccacctgagtgtggccatctgactgtcttggggtccacacactcatttttgttctgtagagcttgtggttgcagagtcagtggtcgtcattaagaaattgctacagatgcagccagcacaacatggagagatcatcaaacacttggcaaagcttacagacaacatccaggtgagggagaagccatattttcactcccc

SEQ ID NO: 9890 - DNA, 446 bp, Homo sapiens
taggggcacagagatagcatctaacatgatcaacactctggtggacaagacagatgatgaaataagcaagttcacatcagggcgggaggtgcttgcagcagcagatttgggccttggttgtttcaggactaacttaaatgtggtgagggtgagtgggggaaagggtgcttagagttcaggaggaaaccaggaacagtctccagcagccaagaaagccaagattctgtagagggctggtcagctgtgacagtggagaggagagtagggctaggctgggttctagacctatcaggtgatggtggccctccctctccccttcactgccttataccacttcagagtccctggcacctggagaatctgccactgctgtaatgggcattaatttctgtgactcaacccaggcagccaacttccagctgtgcacccagacccgacgttctctt

SEQ ID NO: 9891 - DNA, 4310 bp, Homo sapiens
  misc_feature (5)..(5): n is a, c, g, or t
cgcgncctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggatttcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctctaaaaaaaaaaaaaaaaaaaaaaaaaaaaaaaaaaaaaaaaaaaaaaaaaaaaaaaaaaaaaaaaaggggggggggcgcacaaataagaaaccacccgcggggggcgcccaaaccatacgaggcgcaccaccgacgtcgttgtgtggaacacagagggggacccacaagaagagggacgagcgctatctaaaaacgcagcgagccgcgggcgacgcgtatataaaacacggacacggagtgggggagaacaaaggggacccccgagggggagactcacgtgtggcagaagagaggccccccttctcatccacggggggcgggggcgaaacccaaaagcaggggcggcccacacacaccccaccaccgacggagccacctatatcgcaaccagcacccccgaggggaggagacacacacataccgcaaactgatgaagcaggcggcatcaaaacagcgggggcaaccaaacgagacagcggggacaatgagcgggagcgccccagcagcaaacaagcaggtggcgaacgaagcaggaggagcctccagctgatggcgagcccaaccactacctcagaacacgaggaggcccacgacgagcaaca

SEQ ID NO: 9892 - DNA, 4164 bp, Homo sapiens
tgacagcgaggtgtatatcaagggaggccctcggtgctgcccacgcctacccagctcaatggtctgtacctatgaccatgcccctggtgtcctgagctcagcctcctacccactaagaaactcaacagtctggtctgtgtttggcagggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggatttcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctctaaaaaaaaaaaaaaaaaaaaaaaaaaaaaaaaaaaaaaaaaaaaaaaaaaaaaaaaaaaaaaaaaggggggggggcgcacaaataagaaaccacccgcggggggcgcccaaaccatacgaggcgcaccaccgacgtcgttgtgtggaacacagagggggacccacaagaagagggacgagcgctatctaaaaacgcagcgagccgcgggcgacgcgtatataaaacacggacacggagtgggggagaacaaaggggacccccgagggggagactcacgtgtggcagaagagaggccccccttctcatccacggggggcgggggcgaaacccaaaagcaggggcggcccacacacaccccaccaccgacggagccacctatatcgcaaccagcacccccgaggggaggagacacacacataccgcaaactgatgaagcaggcggcatcaaaacagcgggggcaaccaaacgagacagcggggacaatgagcgggagcgccccagcagcaaacaagcaggtggcgaacgaagcaggaggagcctccagctgatggcgagcccaaccactacctcagaacacgaggaggcccacgacgagcaaca

SEQ ID NO: 9893 - DNA, 4195 bp, Homo sapiens
gaacagcagcttttgcaatgatttctgggaaaaaggagtgtaaggttgaactccggaagggagaccagcttgcatctgctgggcggtcacctcaggcattaaaacaggcccctccaaaaaaacccttacaaggaacaggaagtgtttcaggtgtttcagcaattttaggtgttctgaaagtttttcagtgtttctggaagtgaagctacccattgcaacacctgttcaggtgtcagatttctgcaaccagagccaaaattaagtgtcccccagatacccatcactggcacaccatccaggctccagtcaagcggcagggaagcaagagctagtggtcgctggggacagtgacttccaaaggtgtggcctccccccatcagggcacctggtgccctttcatagctctgcctccacctctgcctttaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggatttcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctctaaaaaaaaaaaaaaaaaaaaaaaaaaaaaaaaaaaaaaaaaaaaaaaaaaaaaaaaaaaaaaaaaggggggggggcgcacaaataagaaaccacccgcggggggcgcccaaaccatacgaggcgcaccaccgacgtcgttgtgtggaacacagagggggacccacaagaagagggacgagcgctatctaaaaacgcagcgagccgcgggcgacgcgtatataaaacacggacacggagtgggggagaacaaaggggacccccgagggggagactcacgtgtggcagaagagaggccccccttctcatccacggggggcgggggcgaaacccaaaagcaggggcggcccacacacaccccaccaccgacggagccacctatatcgcaaccagcacccccgaggggaggagacacacacataccgcaaactgatgaagcaggcggcatcaaaacagcgggggcaaccaaacgagacagcggggacaatgagcgggagcgccccagcagcaaacaagcaggtggcgaacgaagcaggaggagcctccagctgatggcgagcccaaccactacctcagaacacgaggaggcccacgacgagcaaca

SEQ ID NO: 9894 - DNA, 4393 bp, Homo sapiens
  misc_feature (5)..(5): n is a, c, g, or t
cgcgncctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacacgtaagtgggcccagcccaggcagagcgggccgaagtgtgtcccggggaggcgcccacagacccgtcggtctccccgtccaggaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggatttcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctctaaaaaaaaaaaaaaaaaaaaaaaaaaaaaaaaaaaaaaaaaaaaaaaaaaaaaaaaaaaaaaaaaggggggggggcgcacaaataagaaaccacccgcggggggcgcccaaaccatacgaggcgcaccaccgacgtcgttgtgtggaacacagagggggacccacaagaagagggacgagcgctatctaaaaacgcagcgagccgcgggcgacgcgtatataaaacacggacacggagtgggggagaacaaaggggacccccgagggggagactcacgtgtggcagaagagaggccccccttctcatccacggggggcgggggcgaaacccaaaagcaggggcggcccacacacaccccaccaccgacggagccacctatatcgcaaccagcacccccgaggggaggagacacacacataccgcaaactgatgaagcaggcggcatcaaaacagcgggggcaaccaaacgagacagcggggacaatgagcgggagcgccccagcagcaaacaagcaggtggcgaacgaagcaggaggagcctccagctgatggcgagcccaaccactacctcagaacacgaggaggcccacgacgagcaaca

SEQ ID NO: 9895 - DNA, 270 bp, Homo sapiens
tcccagtgtccagcctgtgtctcccccagcaattgtgtctaccagtctggctgctgacctggagggcctgacactcacagactccaccctggtaccgtcggtgagtgggatggaggaggggaccgggctggggcagggacacatccctgtgctgcatcctatggtgtggatgtgtgtggggggtgggtgtgatggaggatgtgatagctttgagtcccagctgctggatggccctaggggacaatgctgggacaggctctctccatcttg

SEQ ID NO: 9896 - DNA, 300 bp, Homo sapiens
ctgagagggcagcagggctgacctccccaggtctggggttgaggtctaggaatgggtattttgcgagagcctccaggcagccatgtgccccgctgtccatggtgctgaaatgcgtgctccttgatccctaggctccctgctcaacccaagccacctccactttgcctcctcatagtcttatctactcccacagtcacccctcccagtgtccagcctgtgtctcccccagcaattgtgtctaccagtctggctgctgacctggagggcctgacactcacagactccaccctggtaccgtcg

SEQ ID NO: 9897 - DNA, 1001 bp, Homo sapiens
  misc_feature (5)..(5): n is a, c, g, or t
cgcgncctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacatttctgtagctatttatgtagcaggctcaataaaatgtcttctctcta

SEQ ID NO: 9898 - DNA, 4636 bp, Homo sapiens
  misc_feature (5)..(5): n is a, c, g, or t
cgcgncctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgagcactacctggtgagggattgcttgtccccacctcccccaggaccacactcaagcttggggtgaggaaggaaatgatttagcccctgggggcccgacctgctgagaaatgtctctgagccaggagaagacactgtctccatgtccctgaactggatgtggatcaaggtaaaggacccggatacactcaggggtgctctcccccactgggagagtttgtccccatggaccgcagctggctggggagatgacatcccaggggtaggggggtgggcacaggtgcctgctgagaagcgttctgctgagaaacgtgctctccccaaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggatttcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctctaaaaaaaaaaaaaaaaaaaaaaaaaaaaaaaaaaaaaaaaaaaaaaaaaaaaaaaaaaaaaaaaaggggggggggcgcacaaataagaaaccacccgcggggggcgcccaaaccatacgaggcgcaccaccgacgtcgttgtgtggaacacagagggggacccacaagaagagggacgagcgctatctaaaaacgcagcgagccgcgggcgacgcgtatataaaacacggacacggagtgggggagaacaaaggggacccccgagggggagactcacgtgtggcagaagagaggccccccttctcatccacggggggcgggggcgaaacccaaaagcaggggcggcccacacacaccccaccaccgacggagccacctatatcgcaaccagcacccccgaggggaggagacacacacataccgcaaactgatgaagcaggcggcatcaaaacagcgggggcaaccaaacgagacagcggggacaatgagcgggagcgccccagcagcaaacaagcaggtggcgaacgaagcaggaggagcctccagctgatggcgagcccaaccactacctcagaacacgaggaggcccacgacgagcaaca

SEQ ID NO: 9899 - DNA, 4372 bp, Homo sapiens
  misc_feature (5)..(5): n is a, c, g, or t
cgcgncctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggagtcaggccccacggagtccgcagacagtgaccctgagtctgagagtgaatcggacagtaagagcagcagtgagagcggctctggggagtccagcagtgagtccgacaatgaagaccaggatgaggatgaggagaaagggagaggcagtgagagtgaacagagtgaggaggatggtaagaggaagacaaagaagaaggtgccagagagaaaaggagaagcgtcatcctctgatgagggcagcgattccagcagtagctcatcagagtccgagatgacatcggagtccgaggaggagcagttagaacctgcctcctggagcaggaaaacacctcccagcagcaaaagtgctcctgcaaccaaggagatctccctgcttgatctagaggattgctccctgctcaacccaagccacctccactttgcctcctcatagtcttatctactcccacagtcacccctcccagtgtccagcctgtgtctcccccagcaattgtgtctaccagtctggctgctgacctggagggcctgacactcacagactccaccctggtaccgtcgcttctgagtccagtatcgggtgttgggcggcaggagctgctgcaccgggtagctggcgaggggctggctgtggactacaccttcagccgccaacctttctccggggatccccacatggtgtccgtgcacatccacttctccaacagctctgatacccccatcaagggcctgcatgtgggcactcccaaactgcctgctggcatcagcatccaagaatttcccgaaattgagtccctggcacctggagaatctgccactgctgtaatgggcattaatttctgtgactcaacccaggcagccaacttccagctgtgcacccagacccgacagttctacgtctccattcagccacctgttggggagctgatggcccctgtgttcatgagtgaaaatgagtttaagaaggaacagggaaagctgatgggcatgaatgagatcacagagaaactcatgctgccagacacctgtcggagtgaccacattgtggtgcagaaagtgactgccactgccaacctgggtcgtgttccttgtgggacatctgatgagtacaggtttgcagggaggacactgactggtggaagcctcgttctgctgaccctggatgcccggccagctggagctgcccagctgactgtcaacagcgagaaaatggtgattggcaccatgctggtaaaggatgtgatacaggctctgacccagtgacttccaaatgctgtgacctgtttggctcccatctatacctccccatgacacctaggctgtcagtctctctcatctttctctctctctctcatcatcctcctcatgccagatagcattcagggtgtcctctctccctctggaggaccaagccctcccctaatgccctccccatggattccttagtgatctgtgcagagagagatggcagccactcccttcagtcctcccagatttctgtagctatttatgtagcaggctcaataaaatgtcttctctctaaaaaaaaaaaaaaaaaaaaaaaaaaaaaaaaaaaaaaaaaaaaaaaaaaaaaaaaaaaaaaaaaggggggggggcgcacaaataagaaaccacccgcggggggcgcccaaaccatacgaggcgcaccaccgacgtcgttgtgtggaacacagagggggacccacaagaagagggacgagcgctatctaaaaacgcagcgagccgcgggcgacgcgtatataaaacacggacacggagtgggggagaacaaaggggacccccgagggggagactcacgtgtggcagaagagaggccccccttctcatccacggggggcgggggcgaaacccaaaagcaggggcggcccacacacaccccaccaccgacggagccacctatatcgcaaccagcacccccgaggggaggagacacacacataccgcaaactgatgaagcaggcggcatcaaaacagcgggggcaaccaaacgagacagcggggacaatgagcgggagcgccccagcagcaaacaagcaggtggcgaacgaagcaggaggagcctccagctgatggcgagcccaaccactacctcagaacacgaggaggcccacgacgagcaaca

SEQ ID NO: 9900 - DNA, 2424 bp, Homo sapiens
  misc_feature (5)..(5): n is a, c, g, or t
cgcgncctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccggggagcccgagtacggccacgaccccgcgagcggcggcatcttctcctccgactacaagcggcatgatgacctgaaggagatgctggacaccaacaaggattctctcaagctggaggccatgaagaggattgtggcgatgattgcccgaggaaagaatgcttcagacctgtttcccgcggtggtgaagaacgtggcctgtaagaacatagaggtgaagaagcttgtctatgtgtacctggtacgctacgctgaggagcagcaagacctggccctgctgtccatctccaccttccaacgtggcctaaaggatcccaaccagctgattcgtgccagtgccctccgtgtcctctctagcatccgtgtgcccatcatagtgcccatcatgatgctagctatcaaggaagccgcctcggacatgtcaccctatgtgcggaaaacagctgcccacgccatccctaaactctacagtttggactctgaccagaaggatcagctgatagaagtcattgagaagcttctggctgacaagaccacgctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacgaatccctactagaggagaacgcggaaaaagccttctacggctcagaggaggacgaggccaagggcgcggggtctgaggagacggccgccgcggccgccccctcccgaaagccctatgtcatggaccccgaccaccggctgctgctgcgcaacaccaaacccctgctgcagagccgcagcgccgcggtggtgatggcggtggcgcagctctacttccacctggcgcccaaggcggaagtgggcgtcatcgccaaggcgctggtgcgcctgctgcgcagccacagtgaggtgcagtacgttgtgctccagaacgtggccaccatgtccatcaagcgccggggtatgtttgagccctacctgaagagcttctacatcaggtccaccgaccccacccagattaagatcctgaagctggaagtgctgaccaacctggccaatgagaccaacattcctactgtcctacgggaattccagacctatattcgcagcatggacaaggactttgtggcagccacaatccaggccattggacgctgtgcaactaacatcggccgagtccgtgacacctgcctcaatggcctggtgcagctgctgtccaaccgtgatgagcttgtggttgcagagtcagtggtcgtcattaagaaattgctacagatgcagccagcacaacatggagagatcatcaaacacttggcaaagcttacagacaacatccaggtgcccatggcccgagccagcatcctgtggctcatcggagagtactgtgagcatgtccccaggattgcacctgatgtcttaagaaaaatggccaagtcattcacagcagaggaggatattgtcaagctgcaggtcatcaacctggcagccaagctctacctgaccaactctaaacagaccaagctgctgacccagtatgtgctgagtctggccaaatatgaccagaactatgatattcgcgaccgggcgcgcttcacccggcagctcatcgtcccttccgagcagggtggggccctcagccgccatgccaagaagctcttcctggcacccaaaccagctccagtcttggagtcatccttcaaagaccgggaccacttccagctgggctcactgtcccacctgcttaatgccaaggccacaggctaccaggagctcccagactggccggaggaagccccagacccatctgtgcgcaacgtggaggtacctgaatggaccaagtgctcaaatcgggagaagagaaaggagaaggaaaaacccttctactcggactctgagggggaaactgaggctcgagggtgacctatgcaaagcctgcgaagctaattagtggcaggacctgaactggaatttagggttagtgattcacctgtccagaccagtgcagtcatacctaccttagctcgagagaacgaatgagtgcagcaagggaagtaagagtatcatacatgcatagtggtgcgcagaggtcatgt

SEQ ID NO: 9901 - DNA, 419 bp, Homo sapiens
ggcagccggccttccacccttcgcgttcaccctctcgtctttgttctttccccagctggtggcgggcagtgtggtgatggcctttgaggaggtctgcccggagcgcatcgacctgattcacaaaaactaccggaaactctgtaacctgctgatcgacgtggaggagtggggccaggtggtcatcatcagcatgctcacccgctacgcccgcacgcagttcctgagccccacccagaacacgtaagtgggcccagcccaggcagagcgggccgaagtgtgtcccggggaggcgcccacagacccgtcggtctccccgtccaggaatccctactagaggagaacgcggaaaaagccttctacggctcagaggaggacgaggccaagggcgcggggtctgaggagacggccgccgcggccgc

SEQ ID NO: 9902 - DNA, 2786 bp, Homo sapiens
ggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggcgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacgtgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatccttacggaggc

SEQ ID NO: 9903 - DNA, 2636 bp, Homo sapiens
gggcactgtggccaatgtgaaccctggacgcacccgccagccagccgggaaccttccctcgcgggctcccagggcgggtctcttcctctctctagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggcgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacgtgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatccttacggaggc

SEQ ID NO: 9904 - DNA, 2632 bp, Homo sapiens
agactcactggctcagagggaggacgcacccgccagccagccgggaaccttccctcgcgggctcccagggcgggtctcttcctctctctagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggcgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacgtgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatccttacggaggc

SEQ ID NO: 9905 - DNA, 2150 bp, Homo sapiens
gggcactgtggccaatgtgaaccctggacgcacccgccagccagccgggaaccttccctcgcgggctcccagggcgggtctcttcctctctctagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggcgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacattttgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatccttacggaggc

SEQ ID NO: 9906 - DNA, 898 bp, Homo sapiens
agactcactggctcagagggaggacgcacccgccagccagccgggaaccttccctcgcgggctcccagggcgggtctcttcctctctctagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggcgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccgaactgacttataaactggggtgggacccaaccggggcgaccccctgcacggtcacccgacaaccgcatcaaagccccgga

SEQ ID NO: 9907 - DNA, 2910 bp, Homo sapiens
ggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggcgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacgtgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatccttacggaggc

SEQ ID NO: 9908 - DNA, 2581 bp, Homo sapiens
gggcactgtggccaatgtgaaccctggacgcacccgccagccagccgggaaccttccctcgcgggctcccagggcgggtctcttcctctctctagccctgctcaggcattcggcaggtccagcagaggtacacctcctgcagcgggttccaagtgcacctccagcctgatgggcctgaccaaggaggcttccaggagcacagaaggggctgcaacccaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggcgcagagacatggatgtgacttcccaagcccggggcgtgggcctggagatgtacccaggcaccgcgcagcctgcggcccccaacaccacctcccccgactctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcctcacacagaattgctacaatcccaaagcgctcgccccgcagggtccaaaggccagcggtgaccagcctgtcacccagctcctccccgccaaccctgcctgccgctgcacctgcctgccgctgcaggaaacatttctgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacgtgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatccttacggaggc

SEQ ID NO: 9909 - DNA, 423 bp, Homo sapiens
ctgaattaaaataaattgaatctctttatataaagttattactcttttatattttacaaacttaaaacaataataaaaagagtttatatttattgtctactatgttccaagtactctacatggattagcttacgtaattcttaaaagagctctataaggcaggaattattattagcccccatgtaccagtatgaaagcagattaactctcatatgcccaacatcctaataagtggcactcttaaccactaacatttgcaaaagccaatgaaatcaacattaaagttataaatgaaacaaacactggcaggatttttcgagggacattctatatgtataacacattgggaaagataaacacatctcaaaatgtgttgaaagcattgaaatcatccatcacacttcagaaaaacaaagcattctt

SEQ ID NO: 9910 - DNA, 415 bp, Homo sapiens
ctcactaccacagaaaagtgctccagtgtctctcagtaaagacagagagagagagggagagagagagagagagaaagagagaaatgtacctctctggccttgacattcctttcatcttatacccacccccccccccaaattattatagattaatcacattagcctgagaattgggacagctgtgtcagatgagcagtgcttctaacactgtaagtcatgggagggaaagaaaggtctgcactgttaggttagaggggaaacgtcaggtcaggcacagctagaaatgagacagaggactgagacagtgtctacctgaggactttgggaagaagcgggatttgaaatgaacttcagaattacatatctagaagagctttatgggaagggataatggggcttttcctaccaataggta

SEQ ID NO: 9911 - DNA, 285 bp, Homo sapiens
gaattaattaatgttcctcattccttaatgtttaaagcatttttaaaatatgaggcctgctagagtacctgatgatgcaaaaatcataaaaagaaattaataaggtcacatgccccaaactgacaataacaatattcaatgacttcacctatagttaatgcatagtctatgaatcttttccatgcaaggtaataaatttctttggtatatttagatatggctaacttaatatcttaagaacataatttaatattttatctctctgacacttaggcataacttaat

SEQ ID NO: 9912 - DNA, 219 bp, Homo sapiens
gactatgtggttcctggtgaaagaacacaatatcacctatagtctgttaaagggatcaaattcattgtgatcaaacttctggatccagccatcaagtttcaggaaatacaaatagcaggacgattttgagttgcattacatatgtaatcagtaacatttagactgtgggaaactcgacaattcaaacaccccaggttcttcatcagataaattattagg

SEQ ID NO: 9913 - DNA, 490 bp, Homo sapiens
gtcacacctccgtgagcggcctcgggctcgcggttgaggctgattgaggaagtgggttcaggcggcccgccgtgcctggcacacggtcagagtcccctgacaggactttcccctttctctgagatgacaatcaggccgctttgctttgcactgccctcagagaagcagtgtgcccagaagtcaagtgtgagctcttgagtcaaaatgcttggatttgaattccaactctgctgcttaccagctgtgtgacatggggtgagtgagttacctgacctctctgtacctctatgtcatcatctttaaaatggagcccacagcaaccagggaaatctaacagaagcctaggatgaagaatttcgggaaagaagaaacgtccagcaaggccaagtccctttgtgtgtcagtctgctttctctctcacacatacgtgcacacaggctcgtacacacaaagatgttaagcaaaatataaagctcctccactgataaat

SEQ ID NO: 9914 - DNA, 417 bp, Homo sapiens
ctacttcctcatgccatcacattgggattagatttcaacatataaattttgtgagggacacaaacattcagtccataacctcccctaggctttaagagatgaggggaagaaacatttatcagagcctggaaggaggccaagtactgtggctcatgcctgtaatcccagaattttgggaggccgaagcagacagatcatttgaggccaggcattcaagatcagcctggccaacatggcaaaaccccatctctactaaaaggacaaaaattagctgagtgtggtggggcacgcctgtagtcccagctactcagcaggctgaggcaggggatcacttgagcttgggaggcagaggctgcagtcagctgagattgtgccactgcaccccagcctgggtgacagagtgagactccatctcaa

SEQ ID NO: 9915 - DNA, 535 bp, Homo sapiens
catacacagaggatagctctgaagagagatacctgtgtagtgcagcttctaaatttcataataaaggtaaaaatgggaaatgttttcagttcagataaggttgactgtgcagctcacatctgtatgtgaagcatagtacggatattcataaggatttttagttatcaaaataggttaaattatattctgtatacttaagatgccagaaatacttctatggaaagagttaaaatctcctatctaaactgttaatattaggtgtttaaagaactcacatagtatgactagtttctctcttaagagttaataaataaggaatctgcactgagaaccattgcaaaggaagctggagacgggtggctttcatagagactgggaatgtgagtgctctctttaaaaaaaaaaataccctccttaaaatattataggtgttcctgcatactcatacagtatttcagtatgattttgtccatagactcaaagagactgttttaaagtatagttctgatcatgtcagacctcttttaaaaaaaaa

SEQ ID NO: 9916 - DNA, 363 bp, Homo sapiens
ggaatcagggcatggaaataaaattcaaaatttgtcatgagaaacacttaatctttaatttttattttgcaaaaacaaccccctctcaaagtgttgacctagtctaaggagtgaactcgaatcccagataaatatttcttttaagcaagtcaaacttttattaaaaagcttggccaaattgaaataaagcctttgcaatacatcttctaatttagcaccttgtaagttcttcagatcagaattatgaaagaatagttcttaaagtatcttattgaagcaatagaatttaaaacaaatagagcaggcattaagactttggaaagatagagaaaagctttcatgagtatttatcacctattaatt

SEQ ID NO: 9917 - DNA, 652 bp, Homo sapiens
cctgatggacatttcagaaatgttctattgatgtttctaacgcaacaagcctcatgatattatccttgtgttaacatcattgtgacatcctccacacacccaagtcaacttggacttatttttctgtctcctacaagcaatggctgctaagtcctgttgattctggctttgaaatgtctagagaataccctctcatgtagtcacttctatttttgttgccctagttcaggccgtactctctcttgcttgcctggaccatgacaagtagctgtctagttggtctcatgggctgctatcgatttcctctcaagagtacccttgaagttgccccagagtgctcttcctaaagaatgacttggtgatgtccctttcctactgaaaaaacttgtggtaagtcccaactgcctactgaatctgtttccaactttactcttcagcctcattttctgcaactccctgtcatctccccatgctgaaccccaagagacaactcacgattgctcgatgagatgtccaatttcattcctttgtgctgttgcttgggttgtttaatgcctagaaactttagcaagacaacatgcaaatattctgcagcttctctgtgccccctcacacctgcctgctccaagcgtcattcttcctttgcagttaa

SEQ ID NO: 9918 - DNA, 357 bp, Homo sapiens
ctggtggctcgcagtaatccagtgaagcaggagatccatcaactcccatgagaagagggctgaagccagggagccaagcagacccactcccacagaaccccacaagctaagacccactggcatggaatccccactggctagcacagcacttggagtctgcctaagaagaccaagttcctggggggaagggtgaccaccattactgcgggtctagccggtggttttcccccaccagtgctagggagactgggtggtttgcgctgggcagaattccccacagtgcagtacagaggctgtggcagatataccattattgcatatccaaaggaatataaatcattctattacaaagataca

SEQ ID NO: 9919 - DNA, 450 bp, Homo sapiens
gtggccgaagaatggtttagaagcagcagtgggatgagggagaatcccgaccccgtctcaaaaggccctcagattggacagtgctcacccacactggtgtgggtgggtcttctgtacgcagtttactatactaattcaagtgccaacttcttccagaaacgccctcacagacacacccagaaatcacatttaccagctatctgggcacccccttgcccagtcaagttgacataaaattaaccatccaccatgtgacaactgaggcagagctcgaagtgctgcagcttcaagctgaggaaagcaggactgtgaccccacaccagatgctgctaggagagcagcgagggaggggcctcctctcagccttcagaggaagcgcagccctgtggcaccttgccatccggcctccagagctgtgtgaatgcatttctgccatttgtagcatgcaat

SEQ ID NO: 9920 - DNA, 363 bp, Homo sapiens
cgccaggggccgcgggcacatccaggaacccgccacactgcagccttgaagctgccgctccttccgaggtggccggcgggaggcgagacggcggcgcgcgccaggtagtccagggactgcgcaggccgcaagtacaggcaggcgggcaggccgggcgccaggctgctgcgctgggtcgcggcgccgcgttgcgaagggccgcacagggagctggcgcggcctcggggctccgcgggggtgctgtcggggcccgctgccgccgccgcgctcacaagccggtagtcgtaggtgagcggctcgggggccgaggggactgttggggggacctggcggcgcggcagtggcaggttgtctcgtccgggc

SEQ ID NO: 9921 - DNA, 567 bp, Homo sapiens
cctgagagaaaggctatttggaaaacactattttagcctttcattgttgccaccaaccctctagtaaaatagtccttgaaagctcaatacataaaagaaaggcagagtgctttggttgcatgggaatgcaccctaccctcctgctcagtctcctcctccctgccctcagcccggggctccacacacagccaaatgtggaaatcagtgacgcattctccccaagtcccacagagccaagggagtgttgactttgttcttttttcattgtaagtgtcttttattttggctggatgtggtggctcacacctgtaaccccagcactttaggaggccaaggcgagtggatcacctgaggccagtagttcgagaccagcctggccaacgtggtgaaaccccatctctactaaaaatacaaaaattagccagatgtggtggcgggtgcctatagtcccagctactcaggaggctgaggcaggagaatggcatgaacccaggaggtggagcttgtagtgagctgagatcgcgccactgcactccagcctgggcgacagagcgagactccgtctca

SEQ ID NO: 9922 - DNA, 544 bp, Homo sapiens
ttttttgagagagagtctcactctgtcacccaggctggagtacagtgctggcacccgcctccatgcccagctaatttttttgtattttttagtagagacggggtttcaccgtgttagccaggatggtctctatctcctgacctcatgatccgcccgcctcggcctcccaaagtgctgggattacaggcgtgagccaccatgcctggccagtccagtttttttttaaatgtagtaccccaaggccccaggcctatccttgattttgcatttacttctcatgaactctgcttgggatccatgaggctactgaagagttagtatactaagtgcccttttatttccaggagaccaggcataaggagaaaagagagttgggtttcttgaggtttctattatctcagtcagagtagaaactacagtcctcattcaccagacagcaagagggaataataaaaagccctagtgaaatgtctgacaatagccaggccctttcctgctgaagatagaaaggaaagtacgcaggcatacaggctcaggttctgag

SEQ ID NO: 9923 - DNA, 675 bp, Homo sapiens
tcctgtgtttcatttcaggctttataaatcctggatcaggacagcctgttgaactcagaaaaaacactatcaaaacacaggggaatacgacaagccccaagtataccttctaaaggaacaggcacagtaaactagatgtgcagacattattgcttccttctattgttttgtgcatcattaatatgttacctttatcttagtgtcgcaacctgtgatcctgagcgtttgtgcgtagtatttagggagcagtagagtggattggttaagaccattgcagggagttagtaatgccaaacctcatagattgcaagaattgtatctggtaaagctccaaacatattccctggcataagtaggctcttgataaatgttagctgctattattactgttgttattagtcgctattgttaaaattcaccagatgtggatggaagaggagcttttgcttaagcctggtgagatgtgcttaccatctagttctaatagttcattcccaccaagcaaatctgttgtgccttctgatgactataaaaaggcagcctctcccagcctcatatcctgctgtctctagatcaccagtttgtgaatctctgcaggtggcagatttcccttggcaacttccttgttcctcaagtccagaattgaagtagatttattcagaggttgttcattca

SEQ ID NO: 9924 - DNA, 389 bp, Homo sapiens
aggacaggtgatggccattccctctctcccccccagggcaaacaatgtggcaaggaactggcccagtgataaggggtctcaacaatcagatatggagccatggagggttcttgagcacagacagagcaaaagtggtatttgtggaacactggttttgaagaaatacataactgaactaaaggggagaccaatgggcaaatatgacactcgaaaaagaagaaaacagaacactcctttaggctagaaatatatatgagtgtcttattttagtctacttggcctcatttttccccatggttgtctgacatgttgcctgggggaacacttacagtcacatgagtaatgacaagaatctctttacgtgctacagggtccttaggcttttcttt

SEQ ID NO: 9925 - DNA, 580 bp, Homo sapiens
ccaataaacgcaatgtggagttctgaattaaatgttggaacagaaaaaaagggggcaaaaggagaaaaactggcagaatatgaataagctctgtggcgtaattaatggtattataccaatattaatttaccagttattaaatattgaaagtgttcccctaaaatcagaaacaaagcaaggatgtatgctgtctctgcctctataccatatggcaatgaagttcctagagagtgcaataaggcaagaacaagaaaaataattagagggaagaataaaaattttcttgataaacatactgaccgagtcaaaaatcctaaggaacctacaaaaaaagtaataagtgaacttagagaggtcaaaggacaaaatagataaaatatattatacttctttacatgctagcaggagacaattggaaagtttttaacttctgctcttcacaagacgccattaagaaaatggaaaggcaagccacagactgggagaaaatatttgtaataactcctctgacaaaggatttacatcctaaacatataaagaacgctcacaatcaaataaaaagaaaacaacctaatgaaaa

SEQ ID NO: 9926 - DNA, 461 bp, Homo sapiens
tgtggtagcaataaaaatggtgagagtggtggaattccggccatattttgaaggcaaagtcaataggatttgctaatgaattaagcagtatgcaatgtaatagttgtctcccaagactatgggtaagaacactacccactgaaacactggcagtgctttttaaaagcccagtgttgggccaggcattgtggctcatgcctgtaatcctagcactttgggaggccgaggcagtggatcacctgaagtcaggacttcgagaccagcctggccaacattgtgaaaccccatctctactaaaaaatacaaaaattagccaggcatggtggcaggcacctataatcccagctactcaggaggctgaggcaggagaatcacttgaaccctgggggcggaggttgcagtgagcagagattgcaccacttcactctagcctgggcaacaaagtgaaactccatctcaaa

SEQ ID NO: 9927 - DNA, 376 bp, Homo sapiens
ggattgcgcagaacagtttgtaacacgtggtaggaggaagtttaagggatcacaaatggggaagggatatccttttctcagcgggccccacaattgaaacatttcaaagtatggctcagagaaaatgcgttttaacatgagtttgtgtttctctaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggatgtgtgact

SEQ ID NO: 9928 - DNA, 470 bp, Homo sapiens
ccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaaggatgtg

SEQ ID NO: 9929 - DNA, 2214 bp, Homo sapiens
tcctgaaaagccagctcgcccggggcggcggcgcagagccgggccggcgcacgaggcagccagcgcggccatgacggcggagaaggcgctgcccctgggcaatgggaaggctgctgaggaggcgcgggagtccgaggcgccgggtggcggctgcagcagcgggggcgcggcgcccgcgcgccacccgcgcgtcaagcgcgacaaggcggtccacgagcgcggccactggaacaacaaggtggagttcgtgctgagcgtggccggggagatcattgggctgggcaacgtgtggcgcttcccctacctgtgctacaagaacggaggaggggcattcctgattccctacgtggtgttttttatttgctgtggaattcctgtttttttcctggagacagctctggggcagttcacaagtgaaggtggcattacgtgttggaggaaagtttgccctttatttgaaggcattggctatgcaacacaggtgattgaggcccatctgaatgtgtactacatcatcatcctggcatgggccattttttacctgagcaactgcttcactactgagctaccctgggctacctgtgggcatgagtggaacacagagaattgtgtggagttccagaaactgaatgtgagcaactacagccatgtgtctctgcagaatgccacctcccctgtcatggagttttgggagcaccgggtcctggccatctctgacgggatcgagcacatcgggaaccttcgctgggagctggccttgtgtctcttggcagcctggaccatctgttacttctgtatctggaaggggaccaagtctacaggaaaggttgtatacgtgactgcgacattcccctacatcatgctgctgatcctcctgatacgaggggtcacgttgcccggggcctcagagggcatcaagttctacttgtaccctgacctctcccggctctccgacccccaggtctgggtagatgctggaacgcagatctttttctcctatgccatttgcctgggctgtctgaccgctctgggaagttataacaattataacaacaactgctacagggactgcatcatgctctgttgcctgaacagcggcaccagcttcgtggctgggtttgccatcttctcagtcctgggttttatggcgtacgagcagggggtacccattgctgaggtggcagagtcaggccccggcctggcctttattgcgtaccccaaggcggtcaccatgatgcctctctccccgctgtgggccaccttgttcttcatgatgctcatcttcctgggcctggacagccagtttgtgtgtgtggaaagcctggtgaccgccgtggtggacatgtaccccaaggttttccggaggggttaccggcgggagctgctcatcctagccttgtctgttatctcctattttctgggcctcgtgatgttaacagagggtggcatgtacatcttccagctctttgactcctatgccgccagtgggatgtgccttctcttcgtggccatctttgagtgcatctgcatcggctgggtgtatggaagcaaccggttctatgataacattgaagacatgattggctaccggccaccgtcgctcattaagtggtgctggatgatcatgacccctgggatctgcgcggggatcttcatcttcttcttgatcaagtacaagccactcaagtacaacaacatctacacctacccagcctggggctatggcattggctggctcatggccctgtcctccatgctctgcatcccgctctggatctgcatcacagtgtggaagacggaggggacgctgcccgagaaactccagaagttgacgacccccagcacagatctgaaaatgcggggcaagcttggggtgagcccacggatggtgacagttaatgactgtgatgccaaactcaagagtgacgggaccatcgcagccatcacagagaaggagacgcacttctgagcggccaccagccatctggggctcttcttcctttcttccccccgtgtatgtaaatgaattcctgaaccccatacttcacctaatggtaggggcttgcttgttttgcacaggattaattaacaagttaattttaaggtggccactgtacactgctctaaagtcatatcccctccccgcccccagtcatcatggaagtaaccactacaaagagataacactgtacggggactgccagatcttctgtc

SEQ ID NO: 9930 - DNA, 574 bp, Homo sapiens
ttctgtctcaggctggagaaagcaaacactcctagccattcctctgactcatgtacaaaacttctctggggtgtgtatgttcccctctgatttattccggacaggaagcaaccggttctatgataacattgaagacatgattggctaccggccaccgtcgctcattaagtggtgctggatgatcatgacccctgggatctgcgcggggatcttcatcttcttcttgatcaagtacaagccactcaagtacaacaacatctacacctacccagcctggggctatggcattggctggctcatggccctgtcctccatgctctgcatcccgctctggatctgcatcacagtgtggaagacggaggggacgctgcccgaggtgagaccgccccaggagggctggtgcgtttgggcagggttcgcgccttgggtcccagtttcctcatctgcatggtgcgcgatgacggcctgcgcccacctgcctcaaggggacgctgtggcaaactcctctctggccaatgttcagtatcatggttgtgcccaaggtgtctctgtgaagtcttttggctgagccagt

SEQ ID NO: 9931 - DNA, 519 bp, Homo sapiens
aaaaaaaaaaagattaaaaatgtaacagtgtgggaaaatgttgataattaatatagagtgaaaaaattcagcacataaaatacttaggtttatatttaaactaagattatgactataatttgtatattctaatttgtgtatttgtaatcttaatatacaaattataaggcaccacgcctggcttttctttttcctcctcagacatgaggtctcgccgttgcccaggctggtcttgaactcctgggctcaggtgatcctcccaccttgacctcccagagtgctgggattacaggcatgagccaccacccctggcctagaaaaatattaaaataccattaaggaatattcaaaactggttattatatcagggtagtagaataagggattttttttttaatctattttccattgcagctggttttgatggttttgaatctgttctctggcattctgtcctgcagttgccaccagctgaccactctgcaatacaacttcttaaacttgcagccaggaggagcc

SEQ ID NO: 9932 - DNA, 503 bp, Homo sapiens
taatgatgaatgtttccaggaaaggaaccagaatgactagaacaggggttggcaaactttttctagaatacaaaaaaggaaaagagacgtaacttctcattctacattcttctgtatcttctggaatttttaactttcacaccattatagacacatgctatgtaccatttcaaaaacttcctgacccaacatcttatgccagctatggaggatcaatttcttgtaagctgtgactgacttcaggcaggtccaaccaaaaagcactgctctgtatttactcattcactacctggaagtatgggaagttaatagctgtagggctaccaatatggaagctggttctaagattcatttcataagcctcctgggaagtttcagtgggatttcagtgggattcagtactagtcactcatggagtggctaacttgaaaatacatcactccttttctgcatatacctcttttctgtactgacaatgtgaaagaatataggcatgttctgag

SEQ ID NO: 9933 - DNA, 588 bp, Homo sapiens
taaaagtacacttaaacatcattaaattatatagatagctggccacttaaaatttttctactttaatttacaagtgttgacatagtaaaagcaaattgtttaaggatgcttcaatatttgtatattcaacttcagaagctttcaacgagtataatacaccttcatgcatttaaattatgcattatttcctataaactgggactatttttaaaagatagtgaaattccagcttcagctcttggatagtgaggtcattgaatacagaagagaaattgagaaaattattctgagagttgaagtaatgtgaattttttttgagtgctatttatttaagtctcaacatttttcaggcttaacagaaagtacgtatcaggagacttttaagaaaccatctactaattgtaatgatatgatgtataaatctaaaattaggaatcaaagactatgtcttatatacagtggacttagttaatatgtttagccaaccaatacttagcatttttctctaaacctcataggtgattttgaccatactagtttgtaaatgttgctagtggcattgtagatggactgtagtacagcagaatt

SEQ ID NO: 9934 - DNA, 288 bp, Homo sapiens
gcctccccgcgctcaccggacctgcactgctggccggtgtgtcaggaaccgggcagagaagcccccagccacatcgtccgaccccaccaggctgcaagctctgtgagggcagaggccccgcctggcgcgcggaaggctgatcttccaacacccagcccagtgtctggcaggatgcatgtggaatgaacccttgcaaagaacctgctagctaggttatgcggcctctcatattaaaaacaaaacaaaaacaataaaacacggcagtacctagaaagtctacaccttact

SEQ ID NO: 9935 - DNA, 416 bp, Homo sapiens
aaaactgctcaatattttaaaaatctaagctcataaaaaccagctctattttaaaagcataaaatgtacaccccaaatccaagcatttacctacctttcccaagagatgaagccaagctgcttagagccaagtttaaaaaattaaaaaagaggccagatgcagcggctcatgcctgtaatcccaagataggaggatggcttgaacccaggagtttgagaccagcctaggcaacatagtgagacctcgtctctacaaaaaataaaaaaattagctgggcatgatggtgcgtgcttgtaattccagctactcgggaggctgaggtggaaggatcgcttgagcctaggagtttgagactacagtgagctatgatcacgtcactacactccagcctgggcaatagagcaagaccctgtct

SEQ ID NO: 9936 - DNA, 717 bp, Homo sapiens
attattgtaacaatattcagcagttaggatcttatccttaaaattgttctgtgtcatactaaacacattatctaaaacctactcctagcttttaaaagcaagcctactttgaatccctttgaaaacaggctgggcatggtagctcaggcctataatcccagcactttgggaagccaaggcagaaggatcacttgaggcccagagtttgaaactagcctgggtaacatagcaagactgtctctacaaaaagttaaaaaattatctgggtgtggtgtcgcacacctggagtcatagctagtcagaaagctgagccaggaggattgcttgaacctaggaggtagaggccacagtgagccatggtcctgccattgcactccatccttagtgacaaagcaagaccctatctcaaaaaaataaaataataaaatgaaaatgaaatcccaaagcatacgtggttcaggcaattgtacatacttttaagtcttaaaatttttgctgggcataatggcttacaattgtaatctcagcactttgggaggctaagacaggaggatcacttgaggccaggagttcaaggccagcctgggcaacatagcaagaccccatctctatttctaaaacagaaagaaaaaactatgtaaagtttcttaattaaagttttttcttgttaaatatttctaatatacagaaaagtccaaaaactaatataactgatac

SEQ ID NO: 9937 - DNA, 399 bp, Homo sapiens
gaacaggtagtgatgctctgatgggggaacaagaaatgatgagatttgagaatcctaaaaaggaagaaaccttgagaaaaacaaatcaaacctagattaaataaagagtgatgaggccgggtgtggtggctcacacctgtaatcccagcactttgggaggccaaagcaggtggatcaccagaggtcaggagtttgagaccatcttggtcaacttggtgaaaccccgtctccactgaaaatacaaaaaaattagctgggcgtagtggcgggtgcctgtgatcccagctactgggaagacagaggcaggagaatcgcttgaactgggaggtagaggatgcagtgagccaagattgcaccactgggctctagcctgggtgacagagtgagactccatctcaa

SEQ ID NO: 9938 - DNA, 459 bp, Homo sapiens
cagcttcctcccatccaactttctcccatagaatcactaaaagcagagaactactctattcctgaagccctataagctgaaactaaatgttaagggacaaaatcccattcctgatgcgtgggccacaccaagagttcaccaaaccactgatgccacaaccagagacacttagaccacaagacaggactagaagccgacagcttcatgctgtgggcagcttctccaaggcactggaataagagtccatattataaagacacatttacccctcttaatgcctacctttttgactcggcagaataatggtgtaatcgaaatttcacaatcagtagcttctgctgggaactagatagaaccctaagagatccttgagtccccctagtgggtgactttgggaacatccctaatacaactggtgctcactctgctttaatccaactcagtcatgggacactagat

SEQ ID NO: 9939 - DNA, 537 bp, Homo sapiens
cagtttcacctatacctctgacttttcccgaaaatcagaaggaagaaattaaggcaccgaagagaaactttgggaccaaaaagaaactttaccgacaaaatatagtgttgaatagaccattctctattcagaagctaaactgtttgtcgccttcccttattgctaaggataagtgctgctcacccattgaacaaaaataactcttttctttcatacatctcaatgtgaacacatctactctaagaagcccaactaagatatggttaattattccaagacacaggtactattaacagtcccccaaaatcaccaaacagttgcttgatgtgatatggagtagaacttgtgaaaagcactgctgagatgtctatatataaacccacaggcttctatactgacatatttcacaatcttttgcatgttgtgtttcaagtaaatggttcacttggtagactattctattcaaaaggctactcttttttcagtgattgttttccagtataattccatcaataaatggtataattgacttataaa

SEQ ID NO: 9940 - DNA, 436 bp, Homo sapiens
aacagcactagggagggcactagccatctaatcctgtgtgacagcagtgtcgctgcagacttggcagctcagaacagcacgtggcctccagatccagttcctgttgtggggctcagccaggttctctgtgcagggtcccatcaggttaaggctgccttcgcagttgagaccacccgccgtccccaccagtggggtccttagcttggcctcccaccactcagagccagcgcaggagccgggtgctgcatcctcacctagtgccacacacagtcacagcagccatcaccgttgccatattctgctggttgaaagcagtctcaggtcccacctgcacccccagggaggggccacacctgggacaggggtcctggggccacgttcaagcctgtccacctcagctggtgaactgtgctggggtttggagagggtgagagta

SEQ ID NO: 9941 - DNA, 342 bp, Homo sapiens
tcccagtcgcaggtatgtctttatccacagtgtgaaaatggactaatacagcagccaacatggtaaccccttgttcccatacaacgggtgtgtatggccccttggcagatatcaatccagtgtccacaactagggaggatttagcaaggggattttattacttgtaacaagttaaggagaacactgggattattcccacaacagtgtcttccctgagcttggggctggatcaggttttgtaagcatggggtaatgaggtgtgatctgatttgatcctgcaatgagttgatgccaggaggcatgatctgaccagatcctgccagggtgtgacccaggagctca

SEQ ID NO: 9942 - DNA, 455 bp, Homo sapiens
gcttattgctaatcacatttctcatggttggtgttttaatgtccccaactcccatttctcctgcctctctgcttgaacaaattaccttatttcctaatttgttagaaagagacctttcactatgactgcatcttcatctttgcatcttcaacttctccccttccctcattaatttgccactatttctggagggggaaaaaagcagctcctatttggtgccaaggaaaaaccctcccactggattctcaatgccctttcctcccacgccctcctagttatcagtatatcccacttttcatgctacagtggtctctcccacaggactaggtccctccctttgcctacagtcatgaacagtccccattacctttgttaagcacgatataaattctaaaaatggtttcatagccatgctccatttcatttttcataaccatagtgtatggtctatagcc

SEQ ID NO: 9943 - DNA, 1005 bp, Homo sapiens
tcttactctgtctcccaggctggagtgcagtggtgcaatctcagcttactacaacctccgcctcctgggctcaagtgatacccccacctcagcctcccaagtagctgggatcacaggcttgcgccactatatccggctaatttttgtatatttcgtagagacagggttttgccatgttgcctaggctggtctcaaactcctgagctcaagtgatccacccgcctcagcctcctaaagtgctgggattataggcctgagccattgtgcccggtcacttccagattttgaagatagagccaacaggatttgttaatggattaggtgtggcaggaggagggggaggaagagagagagagactggagttgaagttaaggctcatttcaaggtttttagcctcaacatgtgcaggaatggagttgtcacttgctagaatgggggagactggaggagaagccggctgggagaggtttttaatgaaggggttggctttggatacattaagtttgacatgcattttagacatccaggtggagatattgaagaggcagttggctataagtgtctgatgtccatattagcggatggggctagagacataaatttgagaattgtcagtgtataaacgttgttttgaaagaaagtggggctgaataatttagaaaggagtgcatagagaaaataagtttactattaaaatagctttaacaggccgggcacggtggctcatgcctgtaatcccagcactttgggaggctggggtgggcagatcaaaaggtcaggagtttgagaccagcctggccaatatggtgaaaccctgtctctactgaaaatacaaaaattagccaggcgttgtaccgggcacctgtagtcccagctacttgggaggttgaggcaggagaatcacttcaacccgggaggtggaggttgcagtgagccaagatcacgccactgcactccagcctgggcaacagagcaagactccgtctcaaaaaaaaaaacaaaac

SEQ ID NO: 9944 - DNA, 671 bp, Homo sapiens
taataagtgtctatctttaagaatgatagctaagaaggcagggatttttgtctggaatatatcccatgtgcacaaaacagtgcctgataaatagaaggcactcaataaatatttactgaatgaaatatttgtttaatgatatgattagctgggaccaggtcaaaaggaacttttatttaattttttttttttttttgagacagagtctcagtctgtcgcccaggctggagtgcagtggtgcagtctcagctcactgcaacctccacctcctgggttcaagcaattctcctgcctcagcctcccaagtagctgggattacaggtgcccgccaccatgcccggctaatttttttgtatttttagtagagacagggtttcaccgtgttagtcaggatggtgtcgatctcctgacctcatgatctgcctgcctcagcctcccaaagtgctgggattacaggcttgagccaccaggtccagcccaaaaggaacttttaatgcaaactgtaaaaccatttaccaaaaatagattaaagccatgcactgttacaaataatctaggtgcatttgtaaaaaatgaacccctagaagttcagtgtctgagaactaatctggtcagattataggtcctgaatgagctgcctttctatgagtataaattctggggaaatatat

SEQ ID NO: 9945 - DNA, 351 bp, Homo sapiens
tctggcctggcacaggattttagacatgcaggcacctgcacagacagacacctcatcctgggacagcaaaacccagccgcatgctactgcttcccctgctgtgccctcctcagacatccctggtccatgtacactcctacctgctgagcccctcctaaaaaaaaaaattaaacatcccctcctaaaaaaaaacaattaaaattaaaaaataaatttaaaaattaaaaatccccttctgctaggtgtgctgttcacgcctgtaatctcagcgactcaggaggctgaggtgggaggatcgcttgaatccaggagttcgagatcgggctgggcaagatggcaagaccccaactc

SEQ ID NO: 9946 - DNA, 326 bp, Homo sapiens
cgtcattcctcctttcctcttattctggctagcttttccacagtgtcatgtaaagaggcagcattttctagaagatgcaagtcatttgaagtagtcatttggttttcttctcatttcactttcagcctgcctttaaaaatgtagctgaggcccaccgctgtggctcacacctgtaatcccagcactttgggaggctgaggcggaaggagcacatgagcccaggagttcaagaccaacctgggcgacagagggagaacctacaaaaaatgaaaaataaaaaatacaaaaatggccgagtgcagtggctcacgcctgtaatcgcagca

SEQ ID NO: 9947 - DNA, 261 bp, Homo sapiens
agacgatgcagataaccctaaatgttacattggaatttaagagatcagtctgaatacatggtttttaagatatataaagaaaaaggcaggcgctgtggctcacacctgtaatcccagcactttgggaggctgaggcggaaggagcacatgagcccaggagttcaagaccaacctgggcgacagagggagaacctacaaaaaatgaaaaataaaaaatacaaaaatggccgagtgcagtggctcacgcctgtaatcgcagca

SEQ ID NO: 9948 - DNA, 721 bp, Homo sapiens
tgtagaaatgggctctcactgtgttgcccagactagtttggaacttctggactcaagtgattcttccatctcagcctcccaaagtgctaggattacaggcgggagccaccacgcctggccagttggagacagttgtatattaacatgcattttaaagaaatactatacagagatccttggtaccctttactcagtttccctaatgatgacttcttctaaaattgtagcataatattacaccaggatattgacctttatctaatccaggtacagatcattccatcccaggaggacctctactgttgcccttttctagccacacctgtctccttcccttctgcttccttcgggtttattttggtcttctttttctagtttcttgagctaggaacttgtattaatgatttgagacctttcctcttttctgatgtaagactctagtgctgtaaatttcccacttagtactgccacagctgcatctcacatatatgttgttttttcattttcattcagttctaggtattttttaaaaatttcctttgataactacttctttgactcattgtcttagttcatttgggctgctataacgaaatatagtagtcccctgttatcagtaacctttggtcaactgtggcctgaatatattacatggaaaatttagaaataattcataagttttaaatcgcatgctgttctgagtagcatgatgaagtcttac

SEQ ID NO: 9949 - DNA, 337 bp, Homo sapiens
ttttttttaattgacaaatctgaccttgagggagagaaaaaataaatgcaaccacaacttgcatggaatgaaaaaagcttttggaattaaatcatttggcagtgactgaaaaataaacatcggagtggcttttgttttaattttgttcagcgcgttgttgatttctttataacaaaagcaatagaaagaaaagatgaagtaatagtgaaccaaacagaaataattttccgtgtattgtgcttgtcttcactgtgagtttagttttctatagtcaatgtcaaattgatcagacttctactgtgtgattgaagtacttctttaaaaaaaaaaaaacact

SEQ ID NO: 9950 - DNA, 351 bp, Homo sapiens
tttcttctttgactcacattttatttagaagcataaagttctggtttccaaatatctgtggattttccaccaacctttccattattaatttctattttaattatactgtggtcagagagcatactgtgtatgaggtaaagtcttctaaatgtattaaaatttgttttcaaacctagaatatagtctatgtccataaatgtttcatgaacacttgaaaaaaaagtatattcttctatgttatatggagtgctctttcaagtcaggccaggttggttaatggttcaagtctattataatcttgctgatattctgcttgtcctattatttattgaaagagtattgaaatctccg

SEQ ID NO: 9951 - DNA, 229 bp, Homo sapiens
tgcctacaactggtacctgctacactctattgggctcatctcttaaatccatctttcttctgccctgttacttagacaaacacccacttcccagcttctaacaacgtgacggcttggctaaaagggattattatccctccagtggggtcccgtagcattgccacacttcagactaaggtaccaggtcactccttgattggaaaataatgttgctaataatactcaaaaa

SEQ ID NO: 9952 - DNA, 826 bp, Homo sapiens
gagacataacaggtagacacagagaatcacaatttaacagagcaggaacccacaagaagaaatttctgcaagaaccagtaccaagttcttttgttccctgtacatcatgactagtttccaacaaaaaaattacaaggcttaccaaaagacaaaaaacacagtttgaagaaacagagcaagcatgagaacaggctcagatatgacagggatgttggaattatcaggttgggaatttaaaataattatgctaaaggttctaatggaaaaataaacaatatgcaagaaccaacagataacgtacaaagagatgaaagttctgagaaaaaaatcaagcataaatgctagaaatcaagaacattgtgacatgaagaatgctttgatgggctcattactaggctagaccctgctgagtaaagaatcagcttgaggctatgtcactagaaacttctaaaactgaaaaacaaagaaaaaaagactagaaaaaaatcagaagagaatattcaagaaccgtggggcaattacaaaaggtgtaacctacacttaatgggaatacaaaaagaagaaagggagaggggaacagaaggatcaaataaacacccactcaaactctgcagcttgaaaggaaatgatattccacatagagacaagacttttgaattactttctctcttccctttctcagaagtccactatcagtttctgacctccaaaaacttttttcttaagagctgaaaaaattcctaaaagaaatggaagatggaagatttaaggaaactgattaactttgcaatttataaataaattttaagccataggattaataaga

SEQ ID NO: 9953 - DNA, 578 bp, Homo sapiens
acacctatagtcctactatagctactcaggaagctgaggcaggagaattgcttgaacccaggaggtggaggttgcagtgagctgagaccatgccattgcactccagcctgggcaacagagtgagacttggtgtcaaaaaaatagtaataaaaaataataatatgaaaggagagaatgaacaaagagagagaaatgagtaaagaaagggatacaaaagattaaaagtgcaacaggatttaaagccatgttgtagacagtgaaccacagaacacctgaccatgactatggcatacgtatttgggattctcttttgaacagagagaaaaaggacaaagaaatgaaaatgatgaaagaaaagagcatgatcaatgagcacagataacagtctaaacatacaaaaattaactggtggtctagaagggatctcttgtccctccaaagaacagaagttatcaaacgttaccctctctaactaaaagagcagcaatgatgtgggcttgctgatttagaaagttcacagtgtttcatgtaaaagccatcggtgagaggcatatttatatatcctccagcaagtgatg

SEQ ID NO: 9954 - DNA, 560 bp, Homo sapiens
agtgaaggacaagtgttggttcttggggccacaaatcgccctcatgccttggatgctgctctccgaagacctgggcgatttgataaagagattgagattggagttcccaatgctcaggaccggctagatattctccagaaactgcttcgaagggtaccccatttgctcactgaggctgagctgctgcagctggcaaatagtgctcatggatacgttggagcagacttgaaagtcttgtgtaatgaagcaggtgagtgtggtttgctatggtgagtctctattgatgcacttatctccagtttacttacatacaaataatttatattttacagatttcttaatggaagtagctttgtttctaattataaaatgtgtaatttttatttgaaaaaatttttattggaaaaacctagatgattcagaagactataaaaaaaaataaaaatcactcaatcctacctctaaaggataaccaccattatagtgtatacagtcagccctccatatccttgggctcagcatctgaggagtcaaccaactgtggtctgaaaatattcagg

SEQ ID NO: 9955 - DNA, 1116 bp, Homo sapiens
cccggggtctctccctactttctttccaactcatcactcccataacctagtgctgttatgggtcaaacttggtagcaggcagcacagacgagggctcaccagacttctctggagaacactctggtccttaagcatgatggtaatcttgaattttggtagtggttaaagcaagaatggccttagctagctggtcagattaggacactctctaccttcttgtcatccatgaatctgccttagtggttacacactgtcttctatcagcagagttccaagcacttacaacagctatttggggcaccagagaaagaactgaggcccactgaattgcactgggtatattccccttaggtggtcctaaaggaaatgagtaaagcaagatttgccacagaagttctctgaacgtgcagaatgtagacctggaggactatgtgctagtgtgagcttcctgagaacctttaagaggcaaattcaagccggcgtggtggctcacacctgtaatcccagcactttgggaggccgaggtgggtggatcccttgaggccaggagttcgagaccagcctggccaacatggtgaaaccctatctctactgaaaatacaagttagccgggcatggtcacgagcgcctataatcccaggttctggggagactgaggcacgagaatcccttgaacccaagaggttcaagattgcagtgagccgagatcacactactgtactctggcctgggcgacagagcaagactccttctcaagaataaataaataaatacatcaataaatacataaatacataaaatgcaaattcagctcaggttcaggagtttgtcagagggagcttgtcacagggctgtaggcaatatacatggattattacattagaatcagcagtacgaatatcatgtgatgcagagtgtggcaagccattgaggcagccagggtcattcgggcttggattgaggacatacctttttagctagcatcttttagcaggttcacttgtgacaatgagaggctgacacatctttgacctctagtcagcggagatgctcttactgtggggagagaggccccagcatagtcaggagcagttctgcactttaccagttctatgc

SEQ ID NO: 9956 - DNA, 385 bp, Homo sapiens
tctaagagctgaactcatagaagcagagtagaattgtagtttccagggcctggaaagacaggaggtgttggggagatgttggcccaaggatatgcaatttcagttagataaagaggagtaagttcaagagatgtattgtacgatatggtgactgtgtcaatgacaatgtattcttgaaaattgctaagaaagtagattttagttacatacgtatacatgtgccatgctggtgtgctgcacccactaactcgtcatctagcattaggtatatctcccattgctatccccccctctgcttgtgcacatgtaccctaaaacttaaagtataataataaaaataaataaattaattaattaattaattaattaaattcatcaaaccgta

SEQ ID NO: 9957 - DNA, 396 bp, Homo sapiens
ccgcttcctcgcgcaggtggcaggtcgcctctggcagaacctcttccttcgttcccagtccccagcctcttggcgttttgtctgacgcctcttttgtgtcggactcgacgctttcagcccgtcctccagtgttttcatccccctctccccaacgttgcactctcagactccgcaaaccccgcccgatttggttcaattaaagttgaccagtatttgttccgagcttaggaagtacttggccaggccatgcgaggcctatatgagaagaatgctaagttcatctgcaagacagacatacagcatctactcttcaagactgctttaaggataagaggaattgaatgtaaagtgctgagttatccataaatgttgtatattattcaacaaaaaaaaaaa

SEQ ID NO: 9958 - DNA, 719 bp, Homo sapiens
gtgacgtaaaggtttcatgctttgactagaagggagaaagaaaaaaaattttaaaaaaaggccgggcgcagtggctcacgcctgtaatcccagcactttgggaggccgaggcgggtggatcacgaggtcaggagatcgagaccatcctggctaacatggtgaagccctgtctctactaaaaaatacaaaaaattagccgggcgtgatggtgggcgcctgtagtcccagctattcgggaggctgaggcaggagaatggcatgaacccaggaggcggagcttgcagtgagccgagatcgcgccactgtactccagcctgggtgacagagcaagactctgtctaaaaaaaaaaaaaaaaaaaaaaaaaacacccaaaacgcaatactatattcatagatcgattgataatgctgagtctgtctttaaagtatgagctgcaaaaatctggctaatcagacatggtaatagagccagctcctgaacatgtacttgaggtgttagtccacatgaaaaaagggtttttatggcaggcatggtggctcacacatgtaatcccagcactttgagagactgaggtgggtggatcacctgaggtcaagagttcaagaccagcttgaccagtatggtgaaaccccgtctggccgggcacggtggttcacgcctgtaatcccggcactttgggaggctgaggcgggcagatcacgaggtcaggagttcgaga

SEQ ID NO: 9959 - DNA, 488 bp, Homo sapiens
cattcagaaatttggatgggacatagtgggaatgtctctctctgctgtcacctcaaaagactggaatggctggagacattgaacagcttgactggagtcaaatgtctgaggtctctgttcactgtcaactaaattcctcagttcttcagtgttctctgtctacatggctagctagcttgggcttgctcacagcatggtagtttcaggtatttagacttcttacatagcagctggcttcttctagagagaaagcagaacctcttaaggctaggcccaggattgagatgccttctgccacattttactgatcaaggcaacttacaagggtagcccacattcaaggggaggcgaagtagattcagcagttgatgggtagaacgatatgcatctatagagggaaaaattgctcatagccatcttagcagatagactgtgtttcatacatataaaagaaaaaagactttcatatatatgaaagaaaaaaaaga

SEQ ID NO: 9960 - DNA, 570 bp, Homo sapiens
agtaatttcttaagtctgaacattaacttttgggtgccacagataactagtatggctcagatcttcagctcccagattcgcaacagctccctggctgttgagaagagttgacttagccttgttctcaggaaaacgatcctgtgcttgagcctgctctggcttctgagaaagccatgggaacctacatctctgcttcatgaaagtagtaagaaaagggctgactcagctgggaggacttccttttccttcttatagggaaaagctggtgtctgtgaagaggagttatcactaccatgactatcaggatggagacgcagatgtgttttccagggagccctttgtggtctggttccaatctccccacactggtaagacccacacaggcctttctgtctgggacctccccaacggcccatgaatgcgcagcagccttgagcatgagcccattaaggaggcattaggctggatgtgacagtgcattgcttctaatacttcaatgtagacgatgcagttcagtgtgatggcaccaggcttgcttctcagaatgccatgactcaagacttccccagc

SEQ ID NO: 9961 - DNA, 1319 bp, Homo sapiens
ctagatgtcagagctggctcccggttgggatatgagtgactttgtggaggatggcgcctaaatgaggcatgccaatttctgcaccaggtgacgaacataagggctccttaaaggctagcccaatgtatctgtatttccttggggattaaaacccatgatcttcagttcctcagagaactgaaagttgcaaggagaaatccagtaattcctgttatctgcaggctttataagtcagtggagcctgcggaagtggccagaatccagcactccaagcactgctgtcttctcacagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagaaaaaaactgctccctgtacttagg

SEQ ID NO: 9962 - DNA, 1092 bp, Homo sapiens
ggcagagcaggggtagacttagcatgtaagggagggtcagttggtcctgcaacaggtaggacatcagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagaaaaaaactgctccctgtacttagg

SEQ ID NO: 9963 - DNA, 1121 bp, Homo sapiens
  misc_feature (698)..(698): n is a, c, g, or t
  misc_feature (705)..(705): n is a, c, g, or t
  misc_feature (724)..(724): n is a, c, g, or t
  misc_feature (726)..(726): n is a, c, g, or t
  misc_feature (740)..(740): n is a, c, g, or t
  misc_feature (858)..(859): n is a, c, g, or t
  misc_feature (863)..(864): n is a, c, g, or t
  misc_feature (869)..(869): n is a, c, g, or t
  misc_feature (871)..(871): n is a, c, g, or t
  misc_feature (884)..(884): n is a, c, g, or t
  misc_feature (887)..(887): n is a, c, g, or t
  misc_feature (901)..(901): n is a, c, g, or t
  misc_feature (903)..(903): n is a, c, g, or t
  misc_feature (909)..(910): n is a, c, g, or t
  misc_feature (922)..(922): n is a, c, g, or t
  misc_feature (926)..(926): n is a, c, g, or t
  misc_feature (940)..(941): n is a, c, g, or t
  misc_feature (945)..(946): n is a, c, g, or t
  misc_feature (954)..(954): n is a, c, g, or t
  misc_feature (966)..(966): n is a, c, g, or t
  misc_feature (970)..(970): n is a, c, g, or t
  misc_feature (974)..(974): n is a, c, g, or t
  misc_feature (993)..(993): n is a, c, g, or t
  misc_feature (1002)..(1002): n is a, c, g, or t
  misc_feature (1013)..(1013): n is a, c, g, or t
  misc_feature (1026)..(1026): n is a, c, g, or t
cagcctatgacacttttgctcctcctgaaatctccatatcttgcttttctcaaattccaaggtagcctttgcgcaacatatcactctccactgactcttgtcccatcagggcccatagtggatggctgtatgggggccatgtgactgaactcctgatcctcgtttcagcccactcatgtgacatgcatggagctcttcagcagggacttactgaccaggacaagagcttgagactttgaggggatctgattgtcactgcacaatcaaggacagtattcccaagagtggatgttgctcaagatagtccaaggaattctatgaagaaaaggactccacagacaataaattttggacaccctgtttcaacacagtgcatcttagagactggtgtttgcaagtatatggagcaggaaacttcatcccgaagatggagaccccggggctgtcagcaggcgttagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaaaaaaaaaaaaaaaaaactcganactagtnctctctctctctctccctngngccgcccggagcanagagcctcgctttggccgatccgccgcccgtccacacccgccgccagagttcacctgggatgatgatatcgccgcgctcgtcgtcgacaacgggctcccggcttgtgcaagggccggnntcgnngggcnangatgcccccgggncgntttcccctcaatcngnggggcnnccccaggcccanggcngtgatggtggggcnntggnntcaagaanggatccctatgngggncgangaggccagagcagagaggnttctcaccntgaagtacccnattgagcagggtntcgtccacagtgggcagccttggggcaattctggcccactcttctataaggagcgggttgtggccccgaggacccccgtgttgtgacgaggctct

SEQ ID NO: 9964 - DNA, 936 bp, Homo sapiens
agtaatttcttaagtctgaacattaacttttgggtgccacagataactagtatggctcagatcttcagctcccagattcgcaacagctccctggctgttgagaagagttgacttagccttgttctcaggaaaacgatcctgtgcttgagcctgctctggcttctgagaaagccatgggaacctacatctctgcttcatgaaagtagtaagaaaagggctgactcagctgggaggacttccttttccttcttatagggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagaaaaaaactgctccctgtacttagg

SEQ ID NO: 9965 - DNA, 822 bp, Homo sapiens
cagtctaccagctttctcttagccatgaagggcaactgggagaaatgagtctttcgtgtactaaaaataggcagcctaatgacccccaagatcattaaaatcccggccactggctggaccctctgggaatgggggacccagataatgcagcctgtgccttctggaggggacagctggtttccctccccagcccagtggtttatgagaccttgacaggggaagtgtgtgacccccgcctctttcctgtttctcagctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagaaaaaaactgctccctgtacttagg

SEQ ID NO: 9966 - DNA, 1486 bp, Homo sapiens
cagcctatgacacttttgctcctcctgaaatctccatatcttgcttttctcaaattccaaggtagcctttgcgcaacatatcactctccactgactcttgtcccatcagggcccatagtggatggctgtatgggggccatgtgactgaactcctgatcctcgtttcagcccactcatgtgacatgcatggagctcttcagcagggacttactgaccaggacaagagcttgagactttgaggggatctgattgtcactgcacaatcaaggacagtattcccaagagtggatgttgctcaagatagtccaaggaattctatgaagaaaaggactccacagacaataaattttggacaccctgtttcaacacagtgcatcttagagactggtgtttgcaagtatatggagcaggaaacttcatcccgaagatggagaccccggggctgtcagcaggcgttagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaattcaaggagaggcataacgtacaactatgtgattagctctcggcttggaagaaacacatataaagaacaatatgcctttctctacaaggaaaagctggtgtctgtgaagaggagttatcactaccatgactatcaggatggagacgcagatgtgttttccagggagccctttgtggtctggttccaatctccccacactgctgtcaaagacttcgtgattatccccctgcacaccaccccagagacatccgttaaggagatcgatgagttggttgaggtctacacggacgtgaaacaccgctggaaggcggagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggattgtgcttagaggacaagaaatcgtcagttctgttgttcccaagtcaaacagtgtttttgacttccagaaagcttacaagctgactgaagaggaggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagaaaaaaactgctccctgtacttagg

SEQ ID NO: 9967 - DNA, 483 bp, Homo sapiens
ggcagagcaggggtagacttagcatgtaagggagggtcagttggtcctgcaacaggtaggacatcagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtcatcaaacgctgtgacatcatactcgtgatggaaatcaaggacagcaacaacaggatctgccccatactgatggagaagctgaacagaaatcaaaggagaggcataacgcacaactacgcaatcaactctcgcttcggaagagacacataccaagcccaacatacctttttctacaagaaaaaccgacattcaagaagaaaaaatacccctactgaacctatcggacagaggccccgacaggccttgca

SEQ ID NO: 9968 - DNA, 473 bp, Homo sapiens
gctttatttttttgcttgtttttggcaagacagaggcaaacaaacagaataaaaatgcccacataggtggtatacatggaatgcaaagggcctctaaatatgtttttcttcccaaccaccacactggtttacaagtctgtattatttttatttttatttttatttttttgagacggagtctcgctcttgtctcccaggctggagtgcaatggcacgatctcggctcactgcaatctccacctcccaggttcaagcgattctcctgccttagcctcctgagttgctgggattacaggcgcccaccaccaagcccacctaatttttatatttttagtagagacggggtttcaccatgttgtccaggctggtcccgaactcctgacctcaggtgttccacacgcatcagcctcccaaagtgctgggattacaggcgtgagccaccatgcccaggtatttttagttttttgagatgg

SEQ ID NO: 9969 - DNA, 474 bp, Homo sapiens
actattttaacttctcagatatttttatatgcacttactgattattagtcacatttcaggtaagattgctacataaaactataagcacttaatatatatttaacaatgaatgaatgaatgaatgaatgactcacttttggataagggcttgcaagtgttggatagtgtggtgttattttttatcaacatttgctggttcctaacttccgtagctctcattacagtcttgttacagtgttgggtgtgttaggcttcagggacaggcctctgaccttctgccctcctttgacctgccttgagactctgagtgtttccctgagttctgtgaaccactctggcaaattaatcgagcccaaaaaggagtcttgggaaccccccacttgaagctggtgggtcagaagttctggagaccctgacttgcaaccagtctctggtctagtgggggtgagggcacagtcttaggatctctacaaa

SEQ ID NO: 9970 - DNA, 459 bp, Homo sapiens
ataccctgagatatctcacaaaggccagtgatgccattcttcatattttgtaaatacagtcctccaaaatcggtattaatatgaaagatgaacagtgaattatttcctctgctcttgtggacagaggtgtacctgtggaagatacatgtcatttccttaagtttttgtatttaaatgaaacaggcatttggagagtagaataacaaatggttaatggcagttgaagaacagcagctgaccaagagggagagtcccatccaaataatgcacacagttaccacatgtccttagctgccacttaggtaaatgtacccttccaagagcaatggatgccctgtaactgtaaactggaaagagttaaatcagaaaaatcgattctcctcagtgtctaagttttttttctctcctgcaaattcttagaacagcaattgtatggcaaaattattcttccttttcaat

SEQ ID NO: 9971 - DNA, 421 bp, Homo sapiens
tacattgatgtgtacatatagacatatatactgatttacattgagatatatatacgtgtgtatatatatgtatatatgtgtatatatgtgtgtatatatatgtatatatgtgtatatatatgtatatatgtaaatttaccaatgtaaatcaacaagggtagctttaaaaagtactgatgcctatgtcccgcccccagataatcttatttaattgatctcggatttggcccaagggttgggatttataagtcttcccagggttctaatgtgcaggtctaggtggagtcaatgtggtatccttgtctcggaaggcctggggcctctatttctgttcaatttcattcatagacattgacctaccaatatttgtgatcttgataagaaatagcgcttctggtttaactttttattcctccctgtc

SEQ ID NO: 9972 - DNA, 515 bp, Homo sapiens
tcctaacaggaagaaaaaagctagaaaaaaatctaccccaaaagtatgacctcattcttggatggaatctctctggtgcttgctcgctgtctctctctctgccccctgtctctgcccgccccgcccccccgccaccgtcccctcaacacacactcataacaaagaagctagctataaatcagagatttacttttagaatgctaaaaaatattaatcactgcgttaataaatatttctgcaatgaatccatctgggtagtttggttttttatctgttgaataaagagttatttataaatcatctattaatgtagtgaataggtattacttttgtgtctggggtgttgttaacgcaaactttgcatctctttggatttacagttgtttatagcaaaagaaaaaatcttttccttttttcttcttttcatgtaaacaacgatggaaacgacgcacgttcgcaacccgcaaagcattagaaagacaccggtgaaagacgcagctcaagagggcgctttg

SEQ ID NO: 9973 - DNA, 260 bp, Homo sapiens
actgaccaaacaaggtttatggaccagacctctgggactgtagccagctcaaactgtactcattggtcagaacacagctcttctaagtctctgaatcacaatcaattttaataccagggtaataatgcacaattatttgcaggatatattcttttacactcatttgcagaataggcattatgttgccttttttatactttcacttagtcttctcaaatgtcttttagagtattttatttttgatgatctatgtacattat

SEQ ID NO: 9974 - DNA, 559 bp, Homo sapiens
acgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagcatcttagacaaacatagctggaaacaacttggagaccaccttaatacagctttgagctcagcatgacttgaatgtcttcaaattcattgccctgactccttctggctgaagagcaagggacctagtctcagggatggagcagccatggctatggcacaaaataaagaatatgct

SEQ ID NO: 9975 - DNA, 758 bp, Homo sapiens
acgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataaggtaatgcatcatgaacattttc

SEQ ID NO: 9976 - DNA, 674 bp, Homo sapiens
acgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaattgtgagtgtgtattttaattcttaaagggtaaaacttgaagcaatgttggtgttggataatgctaacacttttctcttgaaatttagcagtagttgtgaacttatctgttcagaaagacctaaagtcacaagaaaaaaggattatgtcatcataaggtttacagtggcaaaggaagcaaaagctgggcatattcagttactcttcatgctttcagcatgcttcagagaagagactccaaaaggaaattgagttcagaggaataggaggaccccaaactataaacttctgaccagtagaagtcttagtgaagaagagtaggatgaaagtggaggcatccatgtagcaagactcttggcaactaaaaacaa

SEQ ID NO: 9977 - DNA, 575 bp, Homo sapiens
acgctgcggccgctatcccctccggaccatggccgacgacgacgtgctgttcgaggatgtgtacgagctgtgcgaggtgatcggaaagtgagtctccacgcgagggagcgggagtgtggaaaaatgcatttcagtgatgccccggtcttcccgcacccgctcggggcctgccccctgccctccctccttcccctcttcccctctcgtccttctcatcctggagtatttatagacgtgtacctggagctcctgccaggcgggggcctgggggttctcagcggtccattgaggccaccgagccgaggttggccaccccgtaaggcgtggggccggctgcctgcattttatctgacggttgcacagggacgtggcacagccgattttatagttgcttcagttggggttattgttaccttgcatgtaccatagaccatttttgaaacagagcagcttgcatttcctttgcttgtgtggtgagagagtccagggttttaattgtggggtgtgtgtctattgtgcgggatattagacagatgcctttgtgtacaccccatgctcggattggagggggtcat

SEQ ID NO: 9978 - DNA, 4221 bp, Homo sapiens
acgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaataaaaaaatgcctttgggtccttcatttcattatagatttgttcaggcttccaagctgataatctttacaattgtataatttgttagatgctcattgaacctttgaaggcccaggagtgagtatcagttggcagggtgacaaagtagcctgccagagcacagctggaccacgtctgactcgcacagagccatgcgcccaagggccacgggtgtactggaggc

SEQ ID NO: 9979 - DNA, 3708 bp, Homo sapiens
aggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactggatcacccatggcttaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaata

SEQ ID NO: 9980 - DNA, 2215 bp, Homo sapiens
atccacgtgccattgtggaatagggtacgcaaaccggtctgggtgctttgtgatgagagtgttttttatgtgtcttctcccaacaccatgtgcgcctaataagactagtgttttcctcttgaatgctggcagttttactacttcttcattggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaata

SEQ ID NO: 9981 - DNA, 3592 bp, Homo sapiens
acgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaata

SEQ ID NO: 9982 - DNA, 1341 bp, Homo sapiens
tggttcagagtgccctgagagaaaagattgagttcctgtctgctgtggtgtctgcgcatgcccactgcagtgccaggacagaatcaagcaagtctctttatctcacttctagtcccctttcttgagagctgtacccagagagctgaggcttgcctggacctcccagcagcctcccaggaaaggtctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaata

SEQ ID NO: 9983 - DNA, 1302 bp, Homo sapiens
acgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggtacatgagcattcacaggtcaccttctacactttgtctgaacacttccagtgacaggaatgcgttgctctatgagatggtcctttttaccttttcttttttctgagcagttttcattagtttttttcatcttgtttgctgttcctgcacatcatctgtgaacatctgaatagaagacataccatttgagtgtcatgcagctatcagagggtaaaaaacaggattaagacagaatatatcaggggaaggcctcttttttctctgccaacatgtgttccaaagatatgcaacatcaacaactgaagtaataccatgttataataaattaactatctttattttgggtgtgactgtgtgctttatagcattaactatttttcagtagatactaggtataaattttcgtcgacgcggccgcgaatttagtagtagtaggcggccgc

SEQ ID NO: 9984 - DNA, 691 bp, Homo sapiens
atgaacaaaaatgtgaaaagagaacgaatccaactgatttctctcttctgtttgcttttccctcctctcatgcccacccctacctccatctcatcaccatttaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattcttt

SEQ ID NO: 9985 - DNA, 3932 bp, Homo sapiens
acgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaata

SEQ ID NO: 9986 - DNA, 4001 bp, Homo sapiens
acgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaata

SEQ ID NO: 9987 - DNA, 3126 bp, Homo sapiens
gccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaata

SEQ ID NO: 9988 - DNA, 3965 bp, Homo sapiens
acgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcgatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaata

SEQ ID NO: 9989 - DNA, 2223 bp, Homo sapiens
acgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggactctcatcacaaagcacccagaccggtttgcgtaccctattccacgtaagcaatgtctcaatct

SEQ ID NO: 9990 - DNA, 2129 bp, Homo sapiens
acgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatgctatcccatgtttccccaaaaaatagtattaaatttagaatgttggagctgatgaggacttcagatgccatcattttatacataaggaaacgtgggcccaaatggagaagcagcagccttccatctggcattgtctttcagtctgatct

SEQ ID NO: 9991 - DNA, 425 bp, Homo sapiens
aaatgtacaaggtctcatcatagaaaacctgaccctgctttaaaggaccatttcaaggaatgtgatcagcaagaaggcagggtggaactaaatatttctcagccctgtcagcattcccaggaccacttcctttatgggaatctcatcatcatctgatgcattctcttcaccctttctggcccagcttggatactatcctttcttgaagtttggaagggagcccaatgtagagcatttctttttcccacctgaattccaaatgaattaagaaacttcgctgttcttcattttaaaaaaggactaaggtggaagatggagcttggcaagtgaagtccccaattaggcagacttatttacccagtcataggcatctaggagggcctgcttgatgagacttaccgcgtggaatagcagagcactgctcc

SEQ ID NO: 9992 - DNA, 2386 bp, Homo sapiens
  misc_feature (1626)..(1626): n is a, c, g, or t
  misc_feature (1651)..(1651): n is a, c, g, or t
aagatcaccaggccccggaacgtcttccagaggggaaagaggctccgtctggggtacaaggagccaggaggtcccccagcgccccccccacccacaggttcgggcgggcagggtgggggaaagccggcagggataattagaaagcggagttcaggcgggggccaatttgccgaggaggagctgcgacaaataccaggctgccaattaagctcgggggaatgtggctggctgggcagtggggagccttgaaaccaccaattaggcctcagctgggatgatcggtcattagggcccagaaggagacccacgcccagcccctgctgctgcggggacatcccaggtgctggggaggccggccaaaggccccatcaccctgcagccgtcctgcccctctctgggcctcagtttccccgtctgtgtattggaggcccagtgaggccttccgggaaggggctgggggggcagccaggagtcctgacctctgccctgggtggtcgaggctgcccgaggtccagctgcctggtctttgtctccgccccaccccggccagcgccagactggccagcctgcattcctgcgctgatttatggtggccggggaggccctttccccttcagctgcctgaggggtgtggggccctcaggtagacccggctggccgggccggtgggtcccatgagcacaggcacgcacacatggccacacgcccggcctcgtcctctgaccccggcccggctgccgccccctcccctccacgttcttcctccgagaccccgtccatcaccgagtcacggatctaggagtgtatctggggtttagtctgttttgttcccagagtctggaatcagccgagcacacagcagttgcctaataaatgctcgttacttgaaccttgattttctcagctgcaaaagtgagccgggcagggcggagagggggacagggcggagagggggacaggacgagcttgccagggaaacgcctgaggcagcaggtactggaatggggaggacttcaccgctggggctgtcctggggtgaacgccatcccccacccaaattcacatcggcccagaacctcagaacgagacgttatttggaaaaagggcctttgcagacgtgatcaaattgagaaaaagtcacagtgaaggccggtgggcactggagacggtcgcacagagacagaggccggccacatgtcaagggactcctggagcccccaggagctgggagaggcggaaggctcctcctgcagcccctggagggagcgcagccctgcggacgcctcgattttggactctgggctccaggacggagggagaacaggtttcgtttgttttacgcccgcggtttgaggtccttcgttacgcagccccccggctaagaaccgcacgtagaggccagcacaccttgggcccttccagggcgagcggaaggtcctctcctctgagattctgacccggtattacggggtctaccctgcctggacccccccttccctggcacagcccctacaagaaacctcaccgcacctcctgcctcagtttccccatctctcaaatagagtgtgtgagaaaacacagcagctttaccccaagcacctggcgccccagctaccctcacatccnggatggggaaaccgaggcgccaggnagcaatcagctgccccatgtacagccagccaaggttggggttggagaggggagccattaactcccaggccaaatggtgggcgaactgggccggtggcgaggcacggtcagacccctgtggggccggggcactgatgcgtggcagtaaagggaggacctgcgggggccccagctgctggcgggggaggcggctctaatggccgttgctgtgggcagccagcaacaaagccagcagtaaaggccgcctgggctttatgggtctctggcccccggttccgctcccctgtggggggcgccccgccctggccagctggccgaggccccagggatgggaaagcaggggacggtgtccaggctgcccatggcggtgtccaggccccccttgtgggccagatcccgggttgaactgctgggccacagcacaccccatggcaaacccaggccttggttctcacctgggttctgtggccgaaaccctgcccctctgaaacgtcaaccagaaagctctgaaatcagccgcccaccacacacccacaggagccctaaacccaggctggagattgggcaaaatctccggaaactccctccccaggggctgagggccgagataagcggcccgcactcccctccacgccgcctgacctccctggggcctgctctgatcacgggaggggtcgggtgtgaagttctgaaggtgcccctccgctgagacccccaccgccccccatcagccccg

SEQ ID NO: 9993 - DNA, 1971 bp, Homo sapiens
  misc_feature (1211)..(1211): n is a, c, g, or t
  misc_feature (1236)..(1236): n is a, c, g, or t
tagatggagtctcgctctgtcgcccaggctggagtgcaatggcgcaatctcagctcgctgcaacctctgtcctgggtggtcgaggctgcccgaggtccagctgcctggtctttgtctccgccccaccccggccagcgccagactggccagcctgcattcctgcgctgatttatggtggccggggaggccctttccccttcagctgcctgaggggtgtggggccctcaggtagacccggctggccgggccggtgggtcccatgagcacaggcacgcacacatggccacacgcccggcctcgtcctctgaccccggcccggctgccgccccctcccctccacgttcttcctccgagaccccgtccatcaccgagtcacggatctaggagtgtatctggggtttagtctgttttgttcccagagtctggaatcagccgagcacacagcagttgcctaataaatgctcgttacttgaaccttgattttctcagctgcaaaagtgagccgggcagggcggagagggggacagggcggagagggggacaggacgagcttgccagggaaacgcctgaggcagcaggtactggaatggggaggacttcaccgctggggctgtcctggggtgaacgccatcccccacccaaattcacatcggcccagaacctcagaacgagacgttatttggaaaaagggcctttgcagacgtgatcaaattgagaaaaagtcacagtgaaggccggtgggcactggagacggtcgcacagagacagaggccggccacatgtcaagggactcctggagcccccaggagctgggagaggcggaaggctcctcctgcagcccctggagggagcgcagccctgcggacgcctcgattttggactctgggctccaggacggagggagaacaggtttcgtttgttttacgcccgcggtttgaggtccttcgttacgcagccccccggctaagaaccgcacgtagaggccagcacaccttgggcccttccagggcgagcggaaggtcctctcctctgagattctgacccggtattacggggtctaccctgcctggacccccccttccctggcacagcccctacaagaaacctcaccgcacctcctgcctcagtttccccatctctcaaatagagtgtgtgagaaaacacagcagctttaccccaagcacctggcgccccagctaccctcacatccnggatggggaaaccgaggcgccaggnagcaatcagctgccccatgtacagccagccaaggttggggttggagaggggagccattaactcccaggccaaatggtgggcgaactgggccggtggcgaggcacggtcagacccctgtggggccggggcactgatgcgtggcagtaaagggaggacctgcgggggccccagctgctggcgggggaggcggctctaatggccgttgctgtgggcagccagcaacaaagccagcagtaaaggccgcctgggctttatgggtctctggcccccggttccgctcccctgtggggggcgccccgccctggccagctggccgaggccccagggatgggaaagcaggggacggtgtccaggctgcccatggcggtgtccaggccccccttgtgggccagatcccgggttgaactgctgggccacagcacaccccatggcaaacccaggccttggttctcacctgggttctgtggccgaaaccctgcccctctgaaacgtcaaccagaaagctctgaaatcagccgcccaccacacacccacaggagccctaaacccaggctggagattgggcaaaatctccggaaactccctccccaggggctgagggccgagataagcggcccgcactcccctccacgccgcctgacctccctggggcctgctctgatcacgggaggggtcgggtgtgaagttctgaaggtgcccctccgctgagacccccaccgccccccatcagccccg

SEQ ID NO: 9994 - DNA, 533 bp, Homo sapiens
caactcattaggctggcattggcacctttccaactttatccctacacctcagctgcacaggatgccttcctggaatgcccttagttctctattcaacctcttcaaggccttctcagccttcacaccatctccatgaaacctttcttgaccacaccagcccatagagctctgtcttgcacacactgcactgctcatttggtgttcagtcacatgctgtttggggaggtttcttgtttttttgttagtattcctgctgttatttctgagctcactttctagctctgtgaatacagggtcagcccttacgccacactggggtcccgtagatgctctttgtgcgattagggaatgctaattagaatactatctctgggctatttatgctgcatcagtcttcctgtcaaacaagttacagttgtgcttatctgtatttccgatgagaatcaggaatttttcttctgtttaatgaatttctgattggtttcaaagtattctaacataagtagccaaattgtactataggcctttaaatg

SEQ ID NO: 9995 - DNA, 413 bp, Homo sapiens
ggctaccaaagcattcactgacttctcaaagccatttctactcagaaaagttaaggccactgacatattgaaatcctttgttttatagatgagaaaacttgctcccatggaaagcgggagacctctccagagcgatcaagccagtcagggacccatgcatgggccaggccactgtcccaaagactttgtgcacagcccctcagtgctctctcaagacaaccctactgaggcagccacagtcatcacctctcttgtacagaagagcatgctgacgcccagaggtttcagttacttcaggaatcatgttgcctcatctccagggctatttgcacttacactgtgttgtccctacacaaaaataaaaccctggggctgtgctgtggtggtgaagaccatgggcttgccacagcccc

SEQ ID NO: 9996 - DNA, 330 bp, Homo sapiens
gagattgtggtgggccaagaccgtgccattgcacttcagcctgggtggcagagtgaaactgtcccccccccaaaaaaaaaattaaaagaaaatatagttattttttattaaaaagggtcatttatgttaacaagtaataggtatattattgttagctttaaatgaatacgaaaacaaattcagttttaatgtctaatatagtgaatactgacagatgttaattcactatacaaaaagccctttaaaagtttcttcattacttttcagtgtgtagtggggtcctgagaccaaaattttgagaactcttactctcaagagagagctaagcat

SEQ ID NO: 9997 - DNA, 412 bp, Homo sapiens
gttcaagtgattctcctgcctcagcctcccaagtagctcggattacaggcacccgccaccactcctggctaatttttgtatttttactagagatgaggattcaccctgctggccaggctggttttgaactcagatgatctgcctgccttggcctcccaaagtgctgggattacaggcatgagccatcgtgcccagccggccaatttcaagttatctgtatgacatcattggaggtgagactgagaagagatgtttagtcaccacgaatatagtgtttctatcatacaaatacaacctcaagaacataaccgcaacaggacagacaatagttaaatgttgcaaaaaacctaagaggtgatgaaagttgtgtatttattatcttttgttttaaatataattacttataagtaat

SEQ ID NO: 9998 - DNA, 411 bp, Homo sapiens
tgtcctctctttataggtttccatttacaaactcaccctatttttcatccatctctccctcctccttttcatgttcaaacactttcatactcgctatgagctaggcctggccttggcacagaggatacaaaggtaaattaagacagaatcactatcctggaagaacatacatcctaatggaaaagtctacatggaaataaaaatatataaaatgtgacagaaatataaattaagtatgtgggtacaccaagaaaaaaaattgttttagaaaggcaagtctttaaaaagaaggtgacacctgaagcagaacttgaagcatcagcaggagttcatgtggaagaaggaggggagggtggattgcaggcaaagaggacagaatgaggaattaattaaataaaggcttttatagaa

SEQ ID NO: 9999 - DNA, 541 bp, Homo sapiens
cagagtcagatttacctacagtttcctggagacaccacctgttccagaaaacctctcctaacactccatgtagacacacatacatgctctcttgcttccaggttgggctaaggtacctgtcatcgcactcatgacaccctttgcatatttttcttgctggattttcactttgttttataattttttgtttaagtatttgtctttccctctagcctacgggctcattggggacaagactcctcttcacctccctgttcccagtgcctcacagtgtttttggcacatggtaggtgctcaccaagtagttaatgaatgaagaaattccgctagtttcatggaataccatttacagagaaaatggcaaagtcatccagatccctcattctgatcagaaacaagaactgctttcagaactgaaaatcccagggggaccccctaaaagctgtcataacccaatttagcatgagaatcatgccattcgctttcatctaaaatgtggcatcacacatagggctagtcccaagatgatctcagtaatggc

SEQ ID NO: 10000 - DNA, 689 bp, Homo sapiens
agaaactgagtcatagagaagtctggtacttacccaaggttacacagctaataaaagggcaagctcaaatgtgaagtgagcttgagcatatgctcttaagctccctgactggtagcagtaagtaatgttaaaataccataagattttgggaccaaagtggtttaaaattacttgaggaaaactccaaacaggtatttggtaagtattgtgatcttggaaagctgcttgtcctctctgcctcagctttatctttacaatagggcaagtaatagtacctcagctcatggttattttgaggattaaataagttaatgtgtgtaatatgcttaaaacagtggctggcacttagcattcaaatgtaaactgctattatttttggacattttctaaagaagaaaccagtcagttagtgaaagctgaggaagacaaaagggggctaattcagctgcatgttttgtatattcagtgtgatcacaagttaaaagctggctactgttgttctttcatccatttatgttgatgagtcttggcatcagtagctgtcaaataatcaatggcttgatacaacttctgagattcagatactaaaggggttgacgtagagataccccatctatgtttttgcctgtcatccagtaagaaggaaatgattcagtggactaaaccctgtcatttctttgaagaatgag

SEQ ID NO: 10001 - DNA, 385 bp, Homo sapiens
tgtctcaaaaaaaaaaaaaaaaaaagaaaagaaaagaaaaattgagaggctcaggcaaattttttatggacccctctaataccataacagacaattaaaagtcaccagacacagtggctcacacctgtaatcccaacacttttggaaggctgaggtgggcggatcatgaggtcaggagatctagaccagcccaggcaacaaagtgagaccttgtttctgttgaaaaaataaaaaatttagccaggtgtggtgtcacatgtctgtgatcccagctacatgggaggctcaggcaaggggatcccttgaacccagtagatggaggccgcagtgagccatgttcatgccaaagcactccagcctgggcaacagaacaagaccctccctc

SEQ ID NO: 10002 - DNA, 578 bp, Homo sapiens
ttttttcctttcaaggccagtcaacatacactggatattccaatatttttcttaaatcaatatgctactttttacccacataacaactttacagtcagaaatatatatgctaatgtacacttagcacttcttaattgttcttaaagctaaatttgaacaataaattaaatttctcagtatatgttatgtaatgtagacacaggctataaaaatgttgacattttatatatctctttctagtcctttgcatttctttatgtattgaagtaaatggttttacttacttgaacatattatcttaattttagtaaagattagtaatgtgcatgctctggtaatattttttaatgccaagcatgcagacatatttgctagaatctgggattatctgccttacccataggaagtctaggcatcctgagcacaaacccaaataaccaaggcatcacagtccaccaggtacaaaacttaagtacagtacatggtagtaaaggaaaagtttcagaaacattatcctgccaattccaaccgtgaaggaatgcaagcaccatgccaaatgaaagaaaaaggaaaaaaag

SEQ ID NO: 10003 - DNA, 450 bp, Homo sapiens
gaaaatagattcctatagccccaatcattttgcaacacttctgcagagttaaaagaaagccagtatctaacagaaaatcttgagcttgcagaataacagaaaagaaaaaaaaaccaaaaacacaacttaccaaaacactgaaactccctctacttatgaaataaacaaactggcttaaattggtggaatcattatggccaaatggtgttttggcagaatcaccttgctgaggtcaccgtctgaattttcactgcctgtttcatcacaactccccttcagtttgcccatgacatccatgaggaggcaatgagcttgagagtaacgtttcagtataaaattgctttctcttaaaaacctgatgtcatagtattggcttctagcacttcaagaagtgagctccttttactcaataacaatgttatctatatcttagagacagtcaacaggaga

SEQ ID NO: 10004 - DNA, 443 bp, Homo sapiens
attctgatacaggacacagcttctgttctgattctggcactgaaatgcagagtaacaaatgtcaggactgtggcactaagattcctacctcccgaagagcctgcaggaaagaaccaactaaagaatttcattatagatacaacactccaggacagaattactcaaatcatagcaaaagaggtgcctttgtccagccccattctttagatgaaagtaaaaactcttcaccctccctggcctctccattttgctgcccaggtcttgtgcactcacctgacacttccaaatccagccctacatctggatggcaagaggctgagctggggctggaaaatatgaaatcgcagtgaccaaggactttgaaagttattaagggctacaccagtgcaagttggtagcaacccataaatgtttgctgaacaaataaatgacttactggataa

SEQ ID NO: 10005 - DNA, 351 bp, Homo sapiens
agtctagcatgggggcttgctcccaagagtactgttccaggaagacatgccccattgtgcaagtactcattcaaacctctgctcgcataatgcttgctaacatgcctttggccaaattaggtcacatagctaacccaaagtcatgtgggtggccatcaacactgggatgtgtgtggctcgttggaggtcactgaagtgaaacctaccgtagttacacagtaagtcagtcaaattcttggtttattggacagctgacagctgttaagaaggaccctatgttaaaggaaatggatacaatctaataacattaacaatagataatggtttttaaccattaacttccattgataa

SEQ ID NO: 10006 - DNA, 277 bp, Homo sapiens
agccaaaccagaaagggacaccgaggcgcgaaaggagagtgatcccagcaggagggacggcaaagattgaagagagcgaccagcccgagagacagggtctcactctatcgctcaggctgaagtgcagtggcggatcaggctcactgcaacctcaacctcctgggctcaagtgatcctcccacctcagcctcccaaagtggtgggattacaggcctgagccacggcaacttgcctcttcctatattttcttttacgcttaaataaattacttaaacat

SEQ ID NO: 10007 - DNA, 312 bp, Homo sapiens
atagtggtggtgtttgagaagataatgtaactacttcttagatttcaatttcataacccttaaaatgttgggaccacctacaaatgggggacaccctgggttttgaagtcttgcctgtgtggttaatcagaacctcagaattcacccagcccccggagaggttttgaaaagcccctggctcatcagagcttgcttgtttcataaactcttaaggctttgttttaacctgtagccagcttcgccttataagctttcttgccccaagccttgagccagtcataatggcttaagcatcagatttcagacaggcga

SEQ ID NO: 10008 - DNA, 465 bp, Homo sapiens
ggtcttttcaaaagcactggttcccattgtatttaaacaggtttaaaaactgaaaaggccccatcttgtgctactctcgagtgggaaaaaaatttctaaacttcatataatatccatgatagagtatatctcaaaaaggcgaaatataagatatttgaacaaactccatgaagtgtattatttgctcattttccaaagcctttgtttttatgtttcatgagaagttttgtttctcttcaggctggataaatatagtagctttcccttgttttcctgtggcatttcatattgtgtctagatttgttagattgcatcagtcacatttgattacattatatcatgtcaaagaacaatgaaaaataagggatttttctaactctttactgaaagaaggaggattcatggtctgccagatttctttctttcttttcttttttttttttttttttgagatggagtctcact

SEQ ID NO: 10009 - DNA, 268 bp, Homo sapiens
tgcccacaacccaacgatatgtttgttattcatacattatgttttagagaaccctgctctgtccagcgagcttgctcatagttaagctcacctggctcaattgctttggtttatcctagagacttttgtaatatttcctcaaagccagtaatgctataataataggtagttcactttttgtttacatttatgattgtaaatgtctctcatttatgaagtattgatttgctggctgatatcaaaataaaatttatttatagaaaatttt

SEQ ID NO: 10010 - DNA, 163 bp, Homo sapiens
taaatcttagagggcgtttaatccaatcctgttttccggagagaaggaaatggacaccagcaagggtgagcgaggcagccgcggtcacagagcttgttagtgggtgaacaagggccccagactcagggaccccatccaggtccgcttagctgggagccccccc

SEQ ID NO: 10011 - DNA, 585 bp, Homo sapiens
ggaagggataaatctggggctgagtacaagcaaaacaagaccaaaggaagctacctgagcaggtattccagatactcatgtcatacaccaaggttgtaccagtgcccctttctctgtgacacatccatccactggaaactttcgtacaactagctgaaagaagagaaacatcctatttcatgtcactggagccctaatgatcgcagccatttcaggaaatgccatcaattacagtgaggagctcattcagaagtgaaagatgagttccattctctgttacttagagggtggatatcctcctccactgaatgcaaactattaagtaatgaaaagacagcactccaagcaatatagatttataggccaacctggcaatcaagggtaactgacatgaaaatggattgcttcacattttaattacaaagatactcttcagtaccataaattgaagaaaacactaactttttgtggctactgtaattgtcaaagtataattacctgtgttttctcacctacgtatttgagatagagacaaaaccaagtaagttaatccacttataataaaaatgtcttctgagaataaat

SEQ ID NO: 10012 - DNA, 337 bp, Homo sapiens
ggaagggataaatctggggctgagtacaagcaaaacaagaccaaaggaagctacctgagcaggtattccagatactcatgtcatacaccaaggttgtaccagtgcccctttctctgtgacacatccatccactggaaactttcgtacaactagctgaaagaagagaaacatcctatttcatgtcactggagccctaatgatcgcagccatttcaggaaatgccatcaattacagtgaggagctcattcagaagtgaaagatgagttccattctctgttacttagaggtcagtgatcattccccaacctcttcatagtgaacaaatagtacagtaaaa

SEQ ID NO: 10013 - DNA, 608 bp, Homo sapiens
ggaagggataaatctggggctgagtacaagcaaaacaagaccaaaggaagctacctgagcaggtattccagatactcatgtcatacaccaaggttgtaccagtgcccctttctctgtgacacatccatccactggaaactttcgtacaactagctgaaagaagagaaacatcctatttcatgtcactggagccctaatgatcgcagccatttcaggaaatgccatcaattacagtgaggagctcattcagaagtgaaagatgagttccattctctgttacttagaggtattacaaagctcaaatctgagaaaaccttgtctaccatcaaccctgacctacagaggagaggcacccccaagcttattagtgatcctgtctccgtcttattggcacatcctgatggccttgatctctagttcttcctgtggagcataaccatatggttctttgccaagatgttaagaccaaagtcggagagtgaaccccatgtcaatgaattcttgtttttctgatcttacattccatcactttgatccagtactctcaaaatgcaatcacagttgtacatgtcttctcctgtcaataaacgctaccttagtactgcagt

SEQ ID NO: 10014 - DNA, 407 bp, Homo sapiens
ggaagggataaatctggggctgagtacaagcaaaacaagaccaaaggaagctacctgagcaggtattccagatactcatgtcatacaccaaggttgtaccagtgcccctttctctgtgacacatccatccactggaaactttcgtacaactagctgaaagaagagaaacatcctatttcatgtcactggagccctaatgatcgcagccatttcaggaaatgccatcaattacagtgaggagctcattcagaagtgaaagatgagttccattctctgttacttagaggaacacaattatttctggaaagagtattacactcagtattctgcatttcatatggcatttcaaagtcctgagaatgactctccgtagtcttctatgtactaattaaacatgaacatgtggt

SEQ ID NO: 10015 - DNA, 368 bp, Homo sapiens
gtgagacgtgccttcgctcctcttttgctttctgccatgactgtgaggcctccccagccatgtggaactggtggatatcctcctccactgaatgcaaactattaagtaatgaaaagacagcactccaagcaatatagatttataggccaacctggcaatcaagggtaactgacatgaaaatggattgcttcacattttaattacaaagatactcttcagtaccataaattgaagaaaacactaactttttgtggctactgtaattgtcaaagtataattacctgtgttttctcacctacgtatttgagatagagacaaaaccaagtaagttaatccacttataataaaaatgtcttctgagaataaat

SEQ ID NO: 10016 - DNA, 701 bp, Homo sapiens
ggaagggataaatctggggctgagtacaagcaaaacaagaccaaaggaagctacctgagcaggtattccagatactcatgtcatacaccaaggttgtaccagtgcccctttctctgtgacacatccatccactggaaactttcgtacaactagctgaaagaagagaaacatcctatttcatgtcactggagccctaatgatcgcagccatttcaggaaatgccatcaattacagtgaggagctcattcagaagtgaaagatgagttccattctctgttacttagagggtggatatcctcctccactgaatgcaaactattaagtaatgaaaagacagcactccaagcaatatagatttataggccaacctggcaatcaagggtaactgacatgaaaatggattgcttcacattttaattacaaagatactcttcagtaccataaattgaagaaaacactaactttttgtggctactgtaattgtcaaagtataattacctgtgttttctcacctacgtatttgagatagagacaaaaccaaattgaagctttgtggcaactctgtgaacagcaagtctgtcagtgccatttttccaatagcatgtgcctactatgtgtctgtgtatgtcattttgttaatttcttcaacatttcaaacttttgtattattattatatttgttatggtgatttgcgatcagt

SEQ ID NO: 10017 - DNA, 412 bp, Homo sapiens
tgcttttataagttgtaacacttaccgtgaagatctgcagctttactcctgagccagcaagaccatgaaccgaccagaaggaagaaactccgaacacatctgaacatcagaaaggacagactccagaagcgccaccttaagggctataacactcaccgcgagggtctgtggcttcgttcttgaagtcagtgagaccaagaacccaccatttctggacacaataagatcctcattccagaggggttcagtcccatacctggctggcagaaatgctacaacatagaggccgagaagaatctggacagacaggcattgctggattcccccaggagatcataccctttctgtcccataatgtttccacataaccatccatttttcatcaactctaagcataaaaaaggagaataaa

SEQ ID NO: 10018 - DNA, 310 bp, Homo sapiens
gaacaacttgtgtttactgagtatctaccatgtatgtgcctgcagagaggatgtcttcattttgcagatgaagtaattagtaaataacttgcctaggttccctcaggtagtgggcccttgaagaatgggcttttatggccaagtgcattggctcacgccagtaatcccagcactttgagcggctgaggtgggaggattgcttgagcccaggagttcaagaccagcctggacaacaaagtgaggccccatttctacaaaaaattagccacatgtggtggcatttgcctgtagtcccagctgcatgggagag

SEQ ID NO: 10019 - DNA, 325 bp, Homo sapiens
taatgtgatgggagggggcacacaggtgtttgaaggtatttttaatgatctgtgtcttcagctaaatggtgagaactcaagtattcatttcactgtcatgtataagtcaatttctatacagtttacttttatacatgtgaaatagtttgtgataagaaagagtaatataaaataaatctggatgcatattgtgttaaaaatcctcttggccaggcacagtggctcacacttgtaatcctaccactttgggaggctgaggtaggggaattgcttgagcccaggagttggaaactagcctgggcaccatagtgagaccctatctcta

SEQ ID NO: 10020 - DNA, 450 bp, Homo sapiens
  misc_feature (381)..(381): n is a, c, g, or t
  misc_feature (427)..(427): n is a, c, g, or t
  misc_feature (429)..(429): n is a, c, g, or t
  misc_feature (434)..(434): n is a, c, g, or t
actattttggcgtgtcccacacacagcatcaagggaggggggtacaagaagaagcagagtgagaccagagtggagtgggagccaaaacaggtgggcgtctgtgcagaaagcaacatggatgcagctggaggccattatcctaagtgaattaacgaaggaacggaaaaccaagaaaggcatgttctcacttataagtgggagctaagcattgagtactcaaggacataaagatggcaaaagtacaccctggggactactagagaggggagggagtgaggggggcaagggttgaaaaactaattgttgggcactacactcaccacctgggtaatgggatcatttgtatctcaaacctctgcatcacgaaatatacccatgtancaaacctgtgcatgtactccctgaatctaaaataaaagctgaaatnanaaaanaaaaatagaacaatcg

SEQ ID NO: 10021 - DNA, 164 bp, Homo sapiens
tggatgatgatagctacaattcagtggatggcatggagctaacatcacaaggtgctggtacttattggtatttaccaccagagtgttttgtggttgggaaagaaccaccaaagatctcaaataaagttgatgtgtggtcggtgggtgtgatcttctatcagtgt

SEQ ID NO: 10022 - DNA, 491 bp, Homo sapiens
  misc_feature (334)..(334): n is a, c, g, or t
  misc_feature (387)..(387): n is a, c, g, or t
  misc_feature (400)..(400): n is a, c, g, or t
aagatggaataggacttttcctaattctttcttctaactacaactaaaacccctgggctatacataaggaaaacacagggagcctctgaaaaaggatgaggcagaccacccagggatcttgggactcgaggaatgacacagtactgagttccttgggtttactttgctttatatatcccagacttggagccaaagaaagaagctgacaacctgaaaatgccagtgggcacaaacacagaaagtgccaacaaaagctcccctgtccagccagaagaccaggaaagggcagcccagtgaggcagaaaacttaaagagtcacttgctctactccagngtccacaccatagaaaaaactatgcagccccacatttacacccgcagaggttnaatggggggagcntagggtttttgacaacagttttaggcattaagggaaggccattcttcccgggggccttggggagggagccagttattgagggcattcctta

SEQ ID NO: 10023 - DNA, 254 bp, Homo sapiens
agtgaatatttgatagtagcttatcctcttaaagtttacagacctcaggccaggctgattctcattagggccaggcatgctggctcaggcctgtaatctcagtgctttgggaagatctcttgaggtcaggagtttcagaccagcctgggcaacatagtgagagcctgtctttaaaaatacatatattaaaaattaggtgggcatgatggcgtacatctatagccctagcttcttgggaggctgaggcaggagga

SEQ ID NO: 10024 - DNA, 369 bp, Homo sapiens
ttaaaggtttatagttttgcctttcacaattttttttataaaatctcttagaattcatctctgtagtaagttaaaggagagatacaatttctgtgttatgtatgtgtgcatataccagttgtcccagaatatgcaaagaccaactttttcacttatcagtagtcataaattggattattatatgtgtatgggacatacaacacatatgtatgtgtcacatatgttgggaattcattattcaattatattggtcaatttgttccctgtgctatttccatgctgtagcagttttataataatttttgggatataacacaaaaatctatttgagactttattaatcctctccataatataactatttttcta

SEQ ID NO: 10025 - DNA, 231 bp, Homo sapiens
tgtggccaaaccctggccctgcacagcctccttgtggcctgagcttattgcaggctgcacggtgcacattacaaatggtcagttggaggccaggcgcggtggctcacgcctgtaatcccagcactttgggaggccgaggcgggtggatcatggggtcaagagatcgagaccatcttggctaacatggtgaaaccccgtctctactaaaaatacaaaaaattagccgggtgt

SEQ ID NO: 10026 - DNA, 2654 bp, Homo sapiens
tcaaagaggcagctgcagtggagaatcatgttaagctcggctactgcggagagcccaaggtagcccaataatggattttgatgagcgtggtccctgctcctctaacatgtatttgccaagttgtacttactacgtctcgggtccagatttctccagcctcccttcttttctgccccagaccccgtcttcgcgcccaatgacatactcctactcctccaacctgccccaggtccaacccgtgcgcgaagtgaccttcagagagtacgccattgagcccgccactaaatggcacccccgcggcaatctggcccactgctactccgcggaggagctcgtgcacagagactgcctgcaggcgcccagcgcggccggcgtgcctggcgacgtgctggccaagagctcggccaacgtctaccaccaccccacccccgcagtctcgtccaatttctatagcaccgtgggcaggaacggcgtcctgccacaggctttcgaccagtttttcgagacagcctacggcaccccggaaaacctcgcctcctccgactaccccggggacaagagcgccgagaaggggcccccggcggccacggcgacctccgcggcggcggcggcggctgcaacgggcgcgccggcaacttcaagttcggacagcggcggcggcggcggctgccgggagacggcggcggcagcagaggagaaagagcggcggcggcgccccgagagcagcagcagccccgagtcgtcttccggccacactgaggacaaggccggcggctccagtggccaacgcacccgcaaaaagcgctgcccctataccaagtaccagatccgagagctggaacgggagttcttcttcagcgtctacattaacaaagagaagcgcctgcaactgtcccgcatgctcaacctcactgatcgtcaagtcaaaatctggtttcagaacaggagaatgaaggaaaaaaaaattaacagagaccgtttacagtactactcagcaaatccactcctctaagactccagcggctggaattgggtggggggcttcatacacatgagataatatgcagattttgcccttgacaaagtcaagccacatggtgacttttgaaaagaggtgtgcaagagagggatgcatggagatagccccacaggaggtggtctgggactctcttgattaagatctcagtggttaagattcctaataatcattggattctgagagctgtgcatcagctagaatgacaggtttgggacccctggtggttcactcttggagcctgcagagctgcgggctgggtgtggtctccactggggattgggcccctgccagaccccctggagactaaccccaccacaccctccctctactgggagcctacccacccccaggacccctgagtaaaaaagctgtgtgctctccaagcccagttcagcttggggacaggggcaggaggaaggggtaggattactaggtgcccagaatgaggctgctttccaaagccaatgtgaacagcggctggacttggaggtagctttgaggtggaagagggctgcaaatccttgtgggaaaagaaatctatgattccaggtggcatcagtgtctttccactcctcctagccacccaccacactgatccagccctgagttcctagccaccgcctcctacagcccacctggcttttctttctaccaaatgagggtcttggttccagcctgccactcaggcccaaagcctcgacacagagtggactgttccctgaggtgggagatgtggaaaagccaagaggctgcagccaggccactggcccctgagatctctgcaggaaatggctgtggagtgtggcagtttggcaaactctccaccacacgtaatgaaacttggatttgctcagtgtctggctgcagagcagtgggcctggccagcaggtccccagctttggctatgagggccttgagtcccccaaaacaccgggttccagcaccacactcagccctcattggctcttgaactgagcttggaagcttctggtgaccttccaagagcctgagagtgaggtggaattattttaaaagataaatattatattatatatatatatatttccctgaaggaaccaaagcgaattttaaaagatgcaatgtagaggggaaaagagatgatgaaaatatttaaaggccctatctgtttacagtgttccgtggttaaactcgctcactgctaagaatatttgaatgtatgcttcatacagggatggtgttcaaaaaacttgtaaataaaggaaccataatcaattttcttttctttctttctctttttcttttttcttttgccattagttgatttcctttagggtgttggagggggtggaaaaggtattgagaatggtctttttaatctcttgcaacatttggaaagagttagggaaatgctcagaggcagtcggcctggccggcctggggatctcatctgggaaagccaggcaccctcccattgaatctcctttgcctccctgtgttaagaaatgtctgttggctccatttgtactgggagtgttggcctgtcctcaattctggttcttacccaccgtgtgtgttgcagcacttatacaggcaactgggcacaaggaaaataaagacggtggaaatttgagta

SEQ ID NO: 10027 - DNA, 2484 bp, Homo sapiens
tcaaagaggcagctgcagtggagaatcatgttaagctcggctactgcggagagcccaaggtccaacccgtgcgcgaagtgaccttcagagagtacgccattgagcccgccactaaatggcacccccgcggcaatctggcccactgctactccgcggaggagctcgtgcacagagactgcctgcaggcgcccagcgcggccggcgtgcctggcgacgtgctggccaagagctcggccaacgtctaccaccaccccacccccgcagtctcgtccaatttctatagcaccgtgggcaggaacggcgtcctgccacaggctttcgaccagtttttcgagacagcctacggcaccccggaaaacctcgcctcctccgactaccccggggacaagagcgccgagaaggggcccccggcggccacggcgacctccgcggcggcggcggcggctgcaacgggcgcgccggcaacttcaagttcggacagcggcggcggcggcggctgccgggagacggcggcggcagcagaggagaaagagcggcggcggcgccccgagagcagcagcagccccgagtcgtcttccggccacactgaggacaaggccggcggctccagtggccaacgcacccgcaaaaagcgctgcccctataccaagtaccagatccgagagctggaacgggagttcttcttcagcgtctacattaacaaagagaagcgcctgcaactgtcccgcatgctcaacctcactgatcgtcaagtcaaaatctggtttcagaacaggagaatgaaggaaaaaaaaattaacagagaccgtttacagtactactcagcaaatccactcctctaagactccagcggctggaattgggtggggggcttcatacacatgagataatatgcagattttgcccttgacaaagtcaagccacatggtgacttttgaaaagaggtgtgcaagagagggatgcatggagatagccccacaggaggtggtctgggactctcttgattaagatctcagtggttaagattcctaataatcattggattctgagagctgtgcatcagctagaatgacaggtttgggacccctggtggttcactcttggagcctgcagagctgcgggctgggtgtggtctccactggggattgggcccctgccagaccccctggagactaaccccaccacaccctccctctactgggagcctacccacccccaggacccctgagtaaaaaagctgtgtgctctccaagcccagttcagcttggggacaggggcaggaggaaggggtaggattactaggtgcccagaatgaggctgctttccaaagccaatgtgaacagcggctggacttggaggtagctttgaggtggaagagggctgcaaatccttgtgggaaaagaaatctatgattccaggtggcatcagtgtctttccactcctcctagccacccaccacactgatccagccctgagttcctagccaccgcctcctacagcccacctggcttttctttctaccaaatgagggtcttggttccagcctgccactcaggcccaaagcctcgacacagagtggactgttccctgaggtgggagatgtggaaaagccaagaggctgcagccaggccactggcccctgagatctctgcaggaaatggctgtggagtgtggcagtttggcaaactctccaccacacgtaatgaaacttggatttgctcagtgtctggctgcagagcagtgggcctggccagcaggtccccagctttggctatgagggccttgagtcccccaaaacaccgggttccagcaccacactcagccctcattggctcttgaactgagcttggaagcttctggtgaccttccaagagcctgagagtgaggtggaattattttaaaagataaatattatattatatatatatatatttccctgaaggaaccaaagcgaattttaaaagatgcaatgtagaggggaaaagagatgatgaaaatatttaaaggccctatctgtttacagtgttccgtggttaaactcgctcactgctaagaatatttgaatgtatgcttcatacagggatggtgttcaaaaaacttgtaaataaaggaaccataatcaattttcttttctttctttctctttttcttttttcttttgccattagttgatttcctttagggtgttggagggggtggaaaaggtattgagaatggtctttttaatctcttgcaacatttggaaagagttagggaaatgctcagaggcagtcggcctggccggcctggggatctcatctgggaaagccaggcaccctcccattgaatctcctttgcctccctgtgttaagaaatgtctgttggctccatttgtactgggagtgttggcctgtcctcaattctggttcttacccaccgtgtgtgttgcagcacttatacaggcaactgggcacaaggaaaataaagacggtggaaatttgagta

SEQ ID NO: 10028 - DNA, 2032 bp, Homo sapiens
tcaaagaggcagctgcagtggagaatcatgttaagctcggctactgcggagagcccaaggtagcccaataatggattttgatgagcgtggtccctgctcctctaacatgtatttgccaagttgtacttactacgtctcgggtccagatttctccagcctcccttcttttctgccccagaccccgtcttcgcgcccaatgacatactcctactcctccaacctgccccaggtccaacccgtgcgcgaagtgaccttcagagagtacgccattgagcccgccactaaatggcacccccgcggcaatctggcccactgctactccgcggaggagctcgtgcacagagactgcctgcaggcgcccagcgcggccggcgtgcctggcgacgtgctggccaagagctcggccaacgtctaccaccaccccacccccgcagtctcgtccaatttctatagcaccgtgggcaggaacggcgtcctgccacaggctttcgaccagtttttcgagacagcctacggcaccccggaaaacctcgcctcctccgactaccccggggacaagagcgccgagaaggggcccccggcggccacggcgacctccgcggcggcggcggcggctgcaacgggcgcgccggcaacttcaagttcggacagcggcggcggcggcggctgccgggagacggcggcggcagcagaggagaaagagcggcggcggcgccccgagagcagcagcagccccgagtcgtcttccggccacactgaggacaaggccggcggctccagtggccaacgcacccgcaaaaagcgctgcccctataccaagtaccagatccgagagctggaacgggagttcttcttcagcgtctacattaacaaagagaagcgcctgcaactgtcccgcatgctcaacctcactgatcgtcaagtcaaaatctggtttcagaacaggagaatgaaggaaaaaaaaattaacagagaccgtttacagtactactcagcaaatccactcctctaagactccagcggctggaattgggtggggggcttcatacacatgagataatatgcagattttgcccttgacaaagtcaagccacatggtgacttttgaaaagaggtgtgcaagagagggatgcatggagatagccccacaggaggtggtctgggactctcttgattaagatctcagtggttaagattcctaataatcattggattctgagagctgtgcatcagctagaatgacaggtttgggacccctggtggttcactcttggagcctgcagaagcagtgggcctggccagcaggtccccagctttggctatgagggccttgagtcccccaaaacaccgggttccagcaccacactcagccctcattggctcttgaactgagcttggaagcttctggtgaccttccaagagcctgagagtgaggtggaattattttaaaagataaatattatattatatatatatatatttccctgaaggaaccaaagcgaattttaaaagatgcaatgtagaggggaaaagagatgatgaaaatatttaaaggccctatctgtttacagtgttccgtggttaaactcgctcactgctaagaatatttgaatgtatgcttcatacagggatggtgttcaaaaaacttgtaaataaaggaaccataatcaattttcttttctttctttctctttttcttttttcttttgccattagttgatttcctttagggtgttggagggggtggaaaaggtattgagaatggtctttttaatctcttgcaacatttggaaagagttagggaaatgctcagaggcagtcggcctggccggcctggggatctcatctgggaaagccaggcaccctcccattgaatctcctttgcctccctgtgttaagaaatgtctgttggctccatttgtactgggagtgttggcctgtcctcaattctggttcttacccaccgtgtgtgttgcagcacttatacaggcaactgggcacaaggaaaataaagacggtggaaatttgagta

SEQ ID NO: 10029 - DNA, 458 bp, Homo sapiens
agggaggagcgtgggaacagtaagttgagatttgttgttcagaggtagcctcgctgagaagttgctatttgaataacgatcaggtgaattaatgagcactaaaataatggggaaagagtgttccaggtaatgggaacagcaagtgccaaggcccagaggtaagagcaggtctcaggaggaaggggtgctgaagtaagaggatcgcttgtgtccaggagtttgaggcagcatggtgcaatctcggttcacagcaacctctacctcccgggttcaagcaattctcctgcctcagctactcaagaggctgaggtgggaggatcacccgagcccagaagttcaaagctgcagtgagctctgatcacaccaatgcactccagcctgggtgacagagccagaccctgtctctaaaaaacaaaaaagaaaagcttgggttgaagccagcccatattcttttatat

SEQ ID NO: 10030 - DNA, 292 bp, Homo sapiens
agggaggagcgtgggaacagtaagttgagatttgttgttcagaggtagcctcgctgagaagttgctatttgaataacgatcaggtgaattaatgagcactaaaataatggggaaagagtgttccaggtaatgggaacagcaagtgccaaggcccagaggtaagagcaggtctcaggaggaaggggtgctgaagtaagaggatcgcttgtgtccaggagtttgaggcagcagtgagctgtgactgcacctctgcactccagcctgggcagcagagtgagaccctgtccccaaa

SEQ ID NO: 10031 - DNA, 459 bp, Homo sapiens
atgaatctatttgaccacttataaaagtcttgtgtggttcaatgtcatggctgagcaaacaaacaaacacctggatactgtgatgtatgagaaaagacagaaactgcatctgtgcctgagtgcagcgagtttgagtaagtcggtagtaaggctgggaatagcacagcatctgcatgtgtgttacacactcagcagagctgatcctgaacacgtgcaagccctcatgattttggccatggtcagcaacactgtcccagagtgatgtgaggctccttctaggataactcatgagtatgtaatttaccatggagtagcctatttatggtacacaggaggataccttgctgtttttccctccaaagttattaaatcttagcggcagttaaaatccaagatatagtatgattttgcacaagatgacaggatgcttcctacactcttcctgtatttgaaaaaaaa

SEQ ID NO: 10032 - DNA, 488 bp, Homo sapiens
caagtttatcttctaagtcttatatcgaaatgtttttctgctgttaacatatttattttcaaaaagcaatttgtatgtatttttcaggcatcgtcttttctgtttgttcaatttggagttcgaggctttcctcaaagcctgataatccttatttgtatgtttatataagaataaggcacttaaggccgggcgcagtggctcagcctgtaatcccagcactttgggaggcagaggcaggcggatcatgaggtcaggagattgagaccatcctggctaacacagtgaaaccccatctctactaaaaatacaaaaaaaaattagctgggcatggtagcgggcgcctgtagtcccagctacttgggaggctgaggcaggagaatggtgtgaacctgggaggtggagcttgcagtgagccgagatcgcaccactgcactccagcctgggtgagagcgagactctgtctcaaaaaaaaaaaaaaagaataaggc

SEQ ID NO: 10033 - DNA, 710 bp, Homo sapiens
ttgagtttggatcccatctctgccatgttcaaattatgcaaacttcagccagccatttatccgttttggaattcaattttctcatctgtaatatgggaacagtcccttttagggttgctgtgaggataaagtacttacaggcacaaagaaaactaactccataaatagtaaaaattattagaagtattgctttttttttttttgagttggagttttgctcttgttgcccaggctggactgcaatggcgtgatctcagctcactgcaacctctgcctcccggttcaagcgattctcctgcctcagcttcccaagtagctgggattacaggcatgtgccaccacacctggctaattttgtatttttagtagagacggggtttctctatgttggtcaggctggtttcgaactcccgacctcaggtgatccacccacctcggcctcccaaagtgctgggattacaggcgtgagccacagagcccattcagcagtattgctttaatgggctacctgggcaagttgtgggcccagacatccatcaatgtgaagtccatgccctgccagccggcagacattttaaccagaccgattaacaacctgtttctgatcaatgatttatggcttatgtttccctgttaatgaaatgtaattgccaagcctgagatgtagcgcagtggcaaaacaaactgccatctgaaaattacatcctagg

SEQ ID NO: 10034 - DNA, 497 bp, Homo sapiens
gtgattatagcctgtaactcccacaaataataggcttcaaaataagaggctgccaacggagcctttgtggctttgtctcagtgatggcacgtaaattgctattaatgtcctaagtgtacttgaatatgccagtctttgggatgtggagttggctcagtgtctctctttacacggcatgtcattgttggtctgataatctggggtaattgctgtctcttggatggtcagaaaagtgtaaggggtttagcttcctgtgtgatggtaaatagcctcaaaatttaccccacgagggcaggttcacacatactggctgtgtgtgtatttcatgtgtagccaccgttcaccgttaagatgtgtatacaatctctgtgtgtacccttagtaaataatagccttgtcaacaaagccaaagcaaaatcaaaggttataaaaatgaaatgacgaattcagggctgtataggttcagccaatcagataatttatattgagagtttaaa

SEQ ID NO: 10035 - DNA, 382 bp, Homo sapiens
ttttttttgagatggagtctcactctgtcgcccaggcttagagtgccagtggtgcttatctcgctcgggctcactgcaacctcccacctcctgggttcaaaggaattctcctgccttagcctcccaagtagctgggattacaggcatgtgccaccatgcctggctaatttttgtatttttagtagagatggggtttcgccttgttggccaggctgctctcctgacctcaggtgatctgcccacctcagcctcacaaagtgctaggattacagatgtgagccactgcgcccagccaaaatttttcctcttttgaaaactgttaccaaaacagactttttattaaactaatattgttttgtgtatttgtcaaatgttacggaat

SEQ ID NO: 10036 - DNA, 599 bp, Homo sapiens
ctggggaccccacccttctctacccagcacttccctgcctccctctagtatcagtagtagagtcttgtgataggctggataatgcccccacaagatatccatgtactaattccaggacttgttgatgttgtcttatgtggcaaaaggaactttgcagaggtgcttaagttgaggattctgagatggagagatcaacctgaattatctggatgggctctaaatgtaatcacacgtgtccttataagaggaacccttgcttacagaagaacaagagatgtgatgatggaagcaacaggttagagagattcaagaaaagcatagccagccaagggaatgcaggcagcctccagaagctaaaaaaaaaaaaaaaaaagaaaagaaaaaagaaaagcaagagaacgattccccctagagcttcctgaaagaactagccatgccaccacattgtcgttatcccagtgagacagatttcaaacttgtggcctcaagaactgtaagggtaagaactgtaaaataaatttatgctgttctaagccacaaaatttgtggcacttttttacagcagcaacaggaaattaataaaagtcttccagtggtag

SEQ ID NO: 10037 - DNA, 576 bp, Homo sapiens
ggaacgtgatcttcccctggagtcctgctgttctcggtagacggacgcctccttccttctctgccatgccgccctgccactcccgctctttgtcactctctgccactctctttctctgctcctctcaatgtccagccacttgtgtttgaggattctgagatggagagatcaacctgaattatctggatgggctctaaatgtaatcacacgtgtccttataagaggaacccttgcttacagaagaacaagagatgtgatgatggaagcaacaggttagagagattcaagaaaagcatagccagccaagggaatgcaggcagcctccagaagctaaaaaaaaaaaaaaaaaagaaaagaaaaaagaaaagcaagagaacgattccccctagagcttcctgaaagaactagccatgccaccacattgtcgttatcccagtgagacagatttcaaacttgtggcctcaagaactgtaagggtaagaactgtaaaataaatttatgctgttctaagccacaaaatttgtggcacttttttacagcagcaacaggaaattaataaaagtcttccagtggtag

SEQ ID NO: 10038 - DNA, 381 bp, Homo sapiens
ccggctcatcacactgcagggaagaacagcaaacctgggagaaagtgactctataaccagtggaagaaaggctgtgtagccatcaccggatctctgggggaagagagaagacacagagacacagacctgccccggaggaatccagagcccacctgcccagagaggctccacctgatttccctggctctgggcacccccttaaaagccctttatgccatctttcctttcagtcgagtgatgcaggatttgggaccagacagcctttgctcaaatccttccactgttatctaccagcttggtggccttggagaagttatttccctgttctggatgtgcttcctcttctataaactagagacactacaaattcccaccacagag

SEQ ID NO: 10039 - DNA, 2575 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10040 - DNA, 2597 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctgacttttctgtgaaaatgagtatt

SEQ ID NO: 10041 - DNA, 2420 bp, Homo sapiens
ggacgcgtgggtcgacccacgcgtcggctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10042 - DNA, 2012 bp, Homo sapiens
  misc_feature (2001)..(2001): n is a, c, g, or t
  misc_feature (2007)..(2007): n is a, c, g, or t
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgaaaatcggggangctcanagcga

SEQ ID NO: 10043 - DNA, 2528 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10044 - DNA, 2440 bp, Homo sapiens
gcctctgcagcgtgtttctgcctggtgtgtgggtgagggaaacctaagtccgccaggaaatcgccttattgtcacctcgcactcttatcctcaatgaaagaagtttgaagattgagtgtcctacaagggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10045 - DNA, 2406 bp, Homo sapiens
ggcccggaaggccaccgctgcggtgattttcctgcatggattgggagatactgggctggagtgcagggcatagtacgctcgtggctcagtacaactcccacctcagtctcccgagtagctggactagcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10046 - DNA, 2399 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaataggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10047 - DNA, 1991 bp, Homo sapiens
  misc_feature (15)..(15): n is a, c, g, or t
  misc_feature (24)..(24): n is a, c, g, or t
  misc_feature (44)..(44): n is a, c, g, or t
  misc_feature (63)..(63): n is a, c, g, or t
  misc_feature (68)..(68): n is a, c, g, or t
acactggaattcggncattatggncgggcactggacttagttgntgggtggagtaggcgcttnctttnacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10048 - DNA, 2533 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10049 - DNA, 2148 bp, Homo sapiens
aaaagattttgccttattttacaggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10050 - DNA, 2476 bp, Homo sapiens
tgatctagaggatcctccgatgtgaaataggtaggtgtggtggcatgcactgtggtcccagctacttggaaggctgaggtggaaggatcacctgatcccaggagatcaaggctgcagtggtccatgattatgctatagcatttcggcactggcgattgtgaaataggtaggtgagaaaactgagccaaatgcaagaggctaagaggagaaagtttcttctatgataaatctttggtatattaatgttcatatcttcccaggaacatcttaggtacatgctctctatcaaatggttagttgtatgtaattctttatgaaagacacagcatagttaatgctatggatttagcgcataattcagtttgaagaatggtagaagctctgctttgtcactcatacttagttgtcagtaattgttcacttactgagacttctcagtgtaggcaccatcgcttctaaacttccctgccccccagtgtcttatattgttccagtataggaagatgcagaactagatactggatgggagctgtcatttcagtgtacaataatcatgataggaaatgtcctgaaatttctgttggagcctcatttctcttttgtcttatttaattgtagtaaaaatgtgatttcgcctttatgcataccatagatttgattagtggcattttagtgggaatttaatttctgacttacataactacctacctattaaattactttattccaaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10051 - DNA, 2513 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaatgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10052 - DNA, 1461 bp, Homo sapiens
  misc_feature (7)..(7): n is a, c, g, or t
gcactgntgcctgcagtcgctctagaggatccccgaatccagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10053 - DNA, 1431 bp, Homo sapiens
  misc_feature (17)..(18): n is a, c, g, or t
gagcggtgctcctcaanntaccgcaaatatacgtacgccccgattatccatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10054 - DNA, 1418 bp, Homo sapiens
tataaatgagcagttaagatataaacaatttatgcctgaacaaatttttcattaagcagcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10055 - DNA, 1281 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgtagaaattgaactggatgcgagatagtagtagggtcgtggtgctggagtttaagttgagtagtaggaatgcggtagtagttaggataatataaatagttaaattaagaatgggttatgttagggttgtacggtagaactgctattattcatcctattgtgggtaattgagggagtatgctaagattttgcgtagctggggtttggttttaatcccacctcaaatgcctgctatgatggataagattgagagagtgaggagaaggcttacgtctagtgagggtgtagaaattgaa

SEQ ID NO: 10056 - DNA, 1040 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcaggtgtagccacacagagagtgactggtggtcatcgaatcccatttccacagtgccaggagaaaacatcactgcctgggatgtgaaaggctctcgtgtactcatgtgttgcagtaacccatggggcatggtcagagtgatggggcttctggatgctggcaggagtacagcttccagaatgtgggatgttgtgagctgggtaggcagatactctgaaggtgtctgctaaatagttattattatcttaaattctcatttagaaagtaataccaaatttaaggggccaggcaacggtgggctcacaccctgtaatcccaacactttgggaaggctgaggcgcgtggattcacctgaaggtcgggacgtttgagaaccaggcttaagcaacatggaggaaaaccccgggtttctaccaaggattcaacattacgcgggtgtggtggtgcatgctgttaatcccagtaaatccggaggctgaaggcgagaatc

SEQ ID NO: 10057 - DNA, 811 bp, Homo sapiens
tgatctagaggatcctccgatgtgaaataggtaggtgtggtggcatgcactgtggtcccagctacttggaaggctgaggtggaaggatcacctgatcccaggagatcaaggctgcagtggtccatgattatgctatagcatttcggcactggcgattgtgaaataggtaggtgagaaaactgagccaaatgcaagaggctaagaggagaaagtttcttctatgataaatctttggtatattaatgttcatatcttcccaggaacatcttaggtacatgctctctatcaaatggttagttgtatgtaattctttatgaaagacacagcatagttaatgctatggatttagcgcataattcagtttgaagaatggtagaagctctgctttgtcactcatacttagttgtcagtaattgttcacttactgagacttctcagtgtaggcaccatcgcttctaaacttccctgccccccagtgtcttatattgttccagtataggaagatgcagaactagatactggatgggagctgtcatttcagtgtacaataatcatgataggaaatgtcctgaaatttctgttggagcctcatttctcttttgtcttatttaattgtagtaaaaatgtgatttcgcctttatgcataccatagatttgattagtggcattttagtgggaatttaatttctgacttacataactacctacctatttcacaatcgccagagatttcctgcatacattaaaaaagacaggcttgtttttctactatatatcccgagcacctagcaacactacctggcccaatcta

SEQ ID NO: 10058 - DNA, 2964 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctgaaaaaaaaaaaaaaaaaaaaaaaaaaaaaaaaaaaaaaaaaaaaaagaaaaaaaaaaacgaccaaagaaaaaaaaaaaaaaaaaggggaggggaagaaaaaaaaaaaacaagcgagaggaacacaaaagaacagaaaaaaatagaagcaaacagcatcagcaaagaagaacataaataaagaaagagaaaggaagaaaagaaaaaaagtagagaaaaaacaaaaccacagagaacgataagtgagaaaaaacacaaaacagagaggaaggaaaatagaggaaaaaaacacagagcgaaagaacacaggaagagaaaaaaaaaaagaagagcaaacagaagaacaacacgaaacaacagaggggaaagaaaaaaacgagagaaaacaaagc

SEQ ID NO: 10059 - DNA, 2531 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcgttttcctgcatggattgggagatactgggcacggatgggcagaagcctttgcaggcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10060 - DNA, 2543 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10061 - DNA, 2473 bp, Homo sapiens
cggcgggcgaggggcagggcagggcggaccctggacgcgcgggcgcgcgcggaaggtagcgcggggccgcgttggcgcgcacgcgcctgagcgtgcgcccggtggggccggccgggactcgccgctcgcacgcccttgggccgcggccgggcgcccgctcttccttccgcttgcgctgtgagctgaggcggtgtatgtgcggcaataacatgtcaaccccgctgcccgccatcgtgcccgccgcccggaaggccaccgctgcggtgattttcctgcatggattgggagatactgggcacggatgggcagaagcctttgcaggtatcagaagttcacatatcaaatatatctgcccgcatgcgcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10062 - DNA, 2192 bp, Homo sapiens
ggcccggaaggccaccgctgcggtgattttcctgcatggattgggagatactgggcacggatgggcagaagcctttgcaggcctgttaggcctgttacattaaatatgaacgtggctatgccttcatggtttgatattattgggctttcaccagattcacaggaggatgaatctgggattaaacaggcagcagaaaatataaaagctttgattgatcaagaagtgaagaatggcattccttctaacagaattattttgggagggttttctcagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10063 - DNA, 2209 bp, Homo sapiens
gcctctgcagcgtgtttctgcctggtgtgtgggtgagggaaacctaagtccgccaggaaatcgccttattgtcacctcgcactcttatcctcaatgaaagaagtttgaagattgagtgtcctacaaggttttcctgcatggattgggagatactggtaaaagctttgattgatcaagaagtgaagaatggcattccttctaacagaattattttgggagggttttctcagggaggagctttatctttatatactgcccttaccacacagcagaaactggcaggtgtcactgcactcagttgctggcttccacttcgggcttcctttccacagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagttggtttttcctttatggtccttcatagcaggccaagtatggcctctctgcaatagacagctactgtcaatacatgctgtaattggacattctggggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctga

SEQ ID NO: 10064 - DNA, 2043 bp, Homo sapiens
aaataggtgacttaaaagaaggcattccatcatagatggcaaaaaaccaaaaatctgttggaccagtaactcttctttttctttgacttgcttagtaggttaaaaagtgataatgaattcaagtttttgttattgttgttcaaaacatcatttttaagacccgaggctctagtgctgcatttcctacctgttaataaaggaatatctggaacataaatatttgtgcagtgagtgggcatttctctagaagtgtttcaacagatacagtacagactcctagaagtagagatgctacagcagtgggtttgcgtatttaacatcttggttgagattgtgaaactttctccgataactttctacccatttataactttagtaatatacaatgtgactttttttagtatccttgctagtattgggcattgtcattgttttaatctttgccaatctgatagttataagtgatactcatttaaatttaaatcacaatatttcttttttaattgaagaaaaaatcagcattaggtgaggtttaccaagcattggtggtgattactgggtattggtggctcagacgtaggatgatggactgttggcatgatattgccttgattgcctaatctgtaactcctaataaatactggaaaattagcttgcctgaaacattggtaagaactttttaaaaattacctttattttcttacttggtccttgactgcatcttgggccccagccagttacatatgcatataatatgatgacaaatgaaaatggttaagacagcatgtatcttgtcgctaaaaggatactcttagggcagagacttgttttgtatattttgaatacgaattttagcctaataacaacaaaatttgcttgaatatatatatattaactactctgtcacttttgctaatctgcattaaaggaaaatcaccttttggttaatgtaagactgtgaccttttctgcgttgctttctgtagtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagta

SEQ ID NO: 10065 - DNA, 1426 bp, Homo sapiens
aaataggtgacttaaaagaaggcattccatcatagatggcaaaaaaccaaaaatctgttggaccagtaactcttctttttctttgacttgcttagtaggttaaaaagtgataatgaattcaagtttttgttattgttgttcaaaacatcatttttaagacccgaggctctagtgctgcatttcctacctgttaataaaggaatatctggaacataaatatttgtgcagtgagtgggcatttctctagaagtgtttcaacagatacagtacagactcctagaagtagagatgctacagcagtgggtttgcgtatttaacatcttggttgagattgtgaaactttctccgataactttctacccatttataactttagtaatatacaatgtgactttttttagtatccttgctagtattgggcattgtcattgttttaatctttgccaatctgatagttataagtgatactcatttaaatttaaatcacaatatttcttttttaattgaagaaaaaatcagcattaggtgaggtttaccaagcattggtggtgattactgggtattggtggctcagacgtaggatgatggactgttggcatgatattgccttgattgcctaatctgtaactcctaataaatactggaaaattagcttgcctgaaacattggtaagaactttttaaaaattacctttattttcttacttggtccttgactgcatcttgggccccagccagttacatatgcatataatatgatgacaaatgaaaatggttaagacagcatgtatcttgtcgctaaaaggatactcttagggcagagacttgttttgtatattttgaatacgaattttagcctaataacaacaaaatttgcttgaatatatatatattaactactctgtcacttttgctaatctgcattaaaggaaaatcaccttttggttaatgtaagactgtgaccttttctgcgttgctttctgtagtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttcttgtgagtattccgtatgacaacattttgtttcttttactacataacagaatgttcttatttttacttaggcatagctcccagatttgcctaattctcacctgtgaattagaatttcatagctggtgactttctagccctctgaagattcacaggcattttttaggagattcctatccttaaaggcagtgattgagttggtttcatattctgttttaactatttacagttta

SEQ ID NO: 10066 - DNA, 2247 bp, Homo sapiens
cgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtgtaacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagta

SEQ ID NO: 10067 - DNA, 1843 bp, Homo sapiens
gggatccccaagcagttattagactcaagttaaacgaatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtgtaacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagta

SEQ ID NO: 10068 - DNA, 1424 bp, Homo sapiens
gctaatagcaatcctccatgaagtgaacaaggaagaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagta

SEQ ID NO: 10069 - DNA, 2392 bp, Homo sapiens
  misc_feature (2259)..(2259): n is a, c, g, or t
  misc_feature (2261)..(2261): n is a, c, g, or t
  misc_feature (2280)..(2280): n is a, c, g, or t
  misc_feature (2282)..(2284): n is a, c, g, or t
cgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtgtaacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagtaaaaaaaaaaaananaaaaaaaaaaaaaaaaaanannnaaaaggcccagtcaattttaagctggggcaaggttttgcatgcggcccaaatttgggcttcttggccaattcgcctatgggaggcggtttaatcgcttgggcaatccc

SEQ ID NO: 10070 - DNA, 410 bp, Homo sapiens
cggccgctcacatgggcgtggccctgcgtgacctgccggggcgtcacgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggtgagccggccgggtgggttggggctgatctttaaggaattcccgactttctcttcgaggtagatcgtcatcgtggtcactggtgccac

SEQ ID NO: 10071 - DNA, 775 bp, Homo sapiens
cgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgaatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtgtaacgtgtattctttcactaatctgtgccttggctcttgcctacttggatcagagagcagagagaatccttcataaagaacaaggaaaaacaggtaagtctaaatgaaagaatgggac

SEQ ID NO: 10072 - DNA, 2604 bp, Homo sapiens
cctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaaaaaaaaaaaaaaaggggcgccgtcgcgatctagaactagtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtgtaacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagta

SEQ ID NO: 10073 - DNA, 2391 bp, Homo sapiens
cttgtcaaggctcagccccgtggcctgcactcacctctcctcctgatggccttagcctcctgattgagactgcacactcagaccatgctgttaggactgagggatttttagtcccccaagtaccaatgagagctggagaagtgacaagtggatgtgtccagagaaggaggccgaggcagaccgtgctctctgtttccacagtatcccttctccatttctcccttactgtgatggtctgagttttgtgttccccacaaattaacatatttcagtcctaacactcaaagtgatggattaggaggtagggcctttgaggggtgattagtggctgtatgaaagaggcccgagagtggcacctcatcttttccatcacgcgaggacacagcaactttgatcttggatttccagccaccagaaccgcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtgtaacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagta

SEQ ID NO: 10074 - DNA, 2134 bp, Homo sapiens
cgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgaatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtgtaacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagta

SEQ ID NO: 10075 - DNA, 2762 bp, Homo sapiens
cgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtgtaacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaagttttctttacagagaaatttggattttcttcccaggcagcaagtgcaattaacagtgttgtatatgtcatatcagctcccatgtccccggtgtttgggctcctggtggataaaacagggaagaacatcatctgggttctttgcgcagtagcagccactcttgtgtcccacatgatgctggcctttacgatgtggaacccttggattgctatgtgtcttctgggactctcctactcattgcttgcctgtgcattgtggccaatggtggcatttgtagttcctgaacatcagctgggaactgcatatggcttcatgcagtccattcagaatcttgggttggccatcatttccatcattgctggtatgatactggattctcgggggtatttgtttttggaagtgttcttcattgcctgtgtttctttgtcacttttatctgtggtcttactctatttggtgaatcgtgcccagggtgggaacctaaattattctgcaagacaaagggaagaaataaaattttcccatactgaatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagtactctcatgtcttcttttgattttaaaaaatacaaaaacactgattttaacttttattcatgcagaagattatctagaagaaaacccaagtcagaataaagagaacttgcccaattacagtcactgaaagattatgggggtagctttttctccagagtagaactttaagtaacatatgtggttttttttatattaagtaaaatatgagtatgaagcttctctgacaaactttaaatactttttaatatttttcagccttaacatattatttgttaaagtcaaagaatgcagatattttagacaagatattaaaccaatgtatttagctgattatattgtttaaagcacatggcatgatattgtaagtgtaaatgtttgggaacagattgaaagtacgttccttatgcaaggtagcttggcagctttatttacatctgtttttctgacttacagtttattgtgttgatatgacttgtctctgtgtccctacccaaatctcatctcgaattgtaatcc

SEQ ID NO: 10076 - DNA, 1127 bp, Homo sapiens
cgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggcagctatttttgctatgataatcctgctgcccttcagactcaagttaaacgagatatgcaagtgaataccacgaaattcatgctgctgtatgcctggtattcttggcccaatgtagttttgtgtttctttggtggctttttgatagaccgagtatttggaatacgatggggcacaatcatttttagctgctttgtttgcattggacaggttgtttttgccctgggtggaatatttaatgctttttggctgatggaatttggaagatttgtatttgggattggtggcgagtccttagcagttgcccagaatacatatgctgtgagctggtttaaaggcaaagaattaaacctggtgtttggacttcaacttagcatggctagaattggaagtacagtaaacatgaacctcatgggatggctgtattctaagattgaagctttgttaggttctgctggtcacacaaccctcgggatcacacttatgattgggggtgtaacgtgtattctttcactaatctgtgccttggctcttgcctacttggatcagagagcagagagaatccttcataaagaacaaggaaaaacaggtgaagttattaaattaactgatgtaaaggacttctccttacccctgtggcttatatttatcatctgtgtctgctattatgttgctgtgttcccttttattggacttgggaaaagtttttctttaccgagaactttggattttcttcccacggcgcaagtgccattcacagtgttggtttgtctatcagtcccattcccggtgttgggcccggtgctctcacgcgcgaaacccctctgggtttgccggacctcttgttcccgtt

SEQ ID NO: 10077 - DNA, 417 bp, Homo sapiens
cagcctgggtatccaccccttgggagagtatgtgtgccgtggagccctgcacagcagttcggggctgccagatgggacctaaaacccagtgctgaggggaaaaagtgtatcaagaatgtatacacaaaagttggccaggcgcggtggcttacttctgtaatgccagcactttgggagcctgaagcgggtggatcacctgagtcaggagttcgagaccagcctgacaaacatggttaaaccccgtctctactagaaatacaaaattagccaggcgtggtggcgcatacctgtaatcccagctactcaggaggctgaggcaggagaatcgcttgaacctgggaggcggaggttgcagtgagccaaggtcgcgccattgcactcctgcctaggcaataagagtgaaactccatctcaaaa

SEQ ID NO: 10078 - DNA, 206 bp, Homo sapiens
ttgtttcttctaaaagacgtatcaagggaaaacacatcttaaagtaaaactgagtaacaaaagttttatccaattgtacaattcccctttatctagctcagttcttgtacgactgcagcccaaagcctgctctgagaaaagggcaggcaacgtggagatttgtgttctactctttctctggcctttggacttccactttattgcag

SEQ ID NO: 10079 - DNA, 164 bp, Homo sapiens
acggcaaagataaaaattgcaacaacaccaaatattggtgaggatacagagaaactggattacttatacatatggtggaaatataaaatggtacagccactccagaaaacactttctcagtttcttaaacatccaaacacgcagccaaccatatgacctggcaa

SEQ ID NO: 10080 - DNA, 359 bp, Homo sapiens
ggaaagggggcaaagctgattgattacaagtaaaatgaaaaaatactgtttctgctaagacagaaagggacctttaatacgcgcccttttaatctgattgtcagaagtaggacagtgcacagtttctcaaagatggccagaggatctgataaaatacaaaagaattgtggaggcgatagtaaacattcttcttcctgtgctgctgatccacaggcttctctttgagaatgactggcctgcaagctgacaagggtgtttacccgctgactctggtggagtccatttggttcaccagaagggcttgagggcagacaaaagaccttgagctctctgcgtgtgccagtcatcctgtgtttcct

SEQ ID NO: 10081 - DNA, 476 bp, Homo sapiens
ggaaactgttgagaaatcctcaaatgcttggtggatgaatcttttctttttgcttctctggatcctctccggacccctctccactctagactgggccctgggaggctgtcctgcatggacctccttgccctctggcttttttgagggtttggccaatggggagcacaataccctgaatgtgtcccaccaatattcgtaggttgaaatcctaaccctgaatatgaatgcactttactttggggagtaatcaggtcatgagcatggagccttcatgaacgggattagtgcccttataagaagagatgcaagggtttgatcttgctctctactctccatcacttggggatacaacaagaaggtgaccatctgcaaaccaggaagcaggcccttcctagacaccagatctgccagcaccttgatctcggacttccagcttccggactgggagaaataaatttctgttgtttataaggcac

SEQ ID NO: 10082 - DNA, 694 bp, Homo sapiens
ggcaagcagcccttgctgattggctcaaagatgtcgagtagaaaaagcagccaatcctgccttcaagccagaactgtgccatggagacattacaaccactgcatggcgagaatgtgtacaaacctgtccgtgccacaaatatcagatcctagttacaaagactgccgccgaaaggaagagcctttgaagccaacactgacactgacctgtcatctacattctattactctagctctctttcggagggaaaaaaaaaactattttaaccaaaagcgcatgagagataaactgtgcccccgctaagatgactcactctattgaggatgaatttccaaacggacggcttagagagagtcccgatgagagaggggctctagaagggtcccattgagggacaaagttgcagatgggggcaggggaggcgggacgagggccaaagacacacaaatgccggggaggggaaagtctccccgcagtctccaaaatccgaacgtgtgagtggctgtgtgtctggacttgaactgagtaaataaacggctctgctaggactatgtgctcaggaaggtggcctgaagttcccagaaggctccgcctggcaaacacctaaggcgcctggaggggcgcaaggtcaggtcccggcgggaacagatctgggaggaaacctcggggggtcgagaggggtgtgtctggggcc

SEQ ID NO: 10083 - DNA, 474 bp, Homo sapiens
tgaagcacacatgctactggaagagaagtccgttacaaaagaatatggtaggtgatgcagagactcacaagagcacaaaagcagcagcagatgactatccgagccactcagttaaggtgatttttaagctatttatcaggaagccaaagatgaaaggggcaatccaaatgaaagaaagaacatgaacaaagacatgcagtcctgaaggaacaggaagtattagagaacaactatgactagagcctagagttcatgtgggggatggtgagaactgagaatggaaaagtagagaaggtaaaaagttgaagaaaaggaaatgaaagatcactcaagttaggcatgcagactgggaatagaagtcagaaaaagaagccctgaagaatccaactagatatgaaaagaatactgagattaaaattagagaagagggacaagcaagataaaattataacacaaaaacaagaagaaaaaata

SEQ ID NO: 10084 - DNA, 670 bp, Homo sapiens
tcttgcccttcacctccttctttgcctacaaggtctccccgattctcatctgcccataaccatggacacagccccaggatgtgcagggtcgagctcccaccctcttggaaatgcctctgaagctgcatagtcctcccctgatgcttgtgctcccttaggggatctccaggcctttgggtgtggtctggcccctggagaagtgtggtcgagtggaggatggggtcctgcagtggccatgatctggacgcccacatcacggggagttttgagggattgagcccactttagcttgggtcttaaaaccaccatggtaagaagtgtcaacctttgggggaaaaataaaaatatatagaaatatttagaaaaacccaccatgggggcctacaagttcctgagtcaaggcctctgccgagactccactgaccagcatggtcactgaagggcatggaggaccgtcctgtgggaagaggcttggacatgcactgtgaactcaagagcaaggacactgtgttgatctggagatgtgggcaatgggcgagtacacacggagcatcctcctgtgccttggaatgggacaaggtggattccagcagccctcagagcttctgctgggtggctttgcaaagaaggggctttccactctactgtggacatctgcagagattgggca

SEQ ID NO: 10085 - DNA, 328 bp, Homo sapiens
ttccttttgcccaggcacatcctcaaccttggtgaaataaacctctaaattgattgagactcacctcagtcattttctatcctcagcaattttcaagtatacaatacatttttattaactataaccacgatgttgtagaatagacctgttgaatttttcctccagtctaagtgaaattttgtatgctttgaccaacatctccacaacctaccccaccaaactgctctcagcttctagacacacacattttctttttttattttttaacttaattttttgttgttgttgttgttgttttttgagacagaatcttactctgttgcccagg

SEQ ID NO: 10086 - DNA, 148 bp, Homo sapiens
catacctcccaagcttataggccatgagaattagtctacacaggtagaatggccttacatcactgttcagacaccttggcctcattgtataggaaaatcttaactctgtttttttgttttcgtttttttaattcttgtcagtcaaaga

SEQ ID NO: 10087 - DNA, 414 bp, Homo sapiens
gaggcggccgttgcagtgagccaagatggcgccattgcactccagactggtcaacaagagcgaaactccgtctcaaaaaaagaaaaagaacagttagaacttttttttttttttttaaagaagagagttcctttctacagcagcgtcagccaccttttggcgaaagaattattgtctagcctttattattctttgtagcaaaagaactccttcccctcctcccatactagtttcactgttgccattacaaatattttattagtacgtatttcctagattcaaagcttcagtgggctttcttcaagtagctgttagaataattgttttgttttgaccataccctttaatattaacaaatgggaggggagattgttaacaaaatactagaatgctcttaactttttttttaactta

SEQ ID NO: 10088 - DNA, 404 bp, Homo sapiens
atccctctaggcccagggactatcaaagtagaggtggttgcctgagactgtaagggctgattttgagggagaagattagttcagtttttctttttgtttgtttgagacaaggtctccctctgtcacccagtgcagtggcgccatcacggcttaccacaacctctgcctcccaggctcaagcaatcttctcacctccacatcctgaatagctgagaccacagatgcacaccaccatacctgccttggcctcccagggtgctgggattacaggtgtgagccaccacactgagcctggagtttctctataaatcagacattaatatcaaaagcacactgatgcatggccagcatctgatcccttgtattggaaaagcagagttttcttggaacatagatctactctt

SEQ ID NO: 10089 - DNA, 276 bp, Homo sapiens
actctcctgtcactgccaagctgaccactattctaacttctatcaccactgattaattttacctaattttgaactgcatttaaatggtgcttttttccccagcaaaatgtttttgagattctctgtgcagatgcacttatcagtaggttttcttttctgttttatttgctaagtcatatttcattgcatggttgtacccaattggtttagcctgctaatatgcactagatggttttcctattgggggtattatgaataaagctgctgtgaactctt

SEQ ID NO: 10090 - DNA, 516 bp, Homo sapiens
tctgatatggcttcataggaacctggccgtccactccacccacgtgccttagcaaagtgcccttggtgaggctgagggactaggcagccaggactcctgaggggaccttatcagagagggaagccacctcggactgagtggtgagtgctgctctaggactgccctaaaactggatttgaacaaaagaccacatgccgtatgactccattggaatgaaacatccagaacaggcaaagccacagaggcaggaagcagcatccccccaggtcagcaacacctctggagctgaggctggcagaatgtggcgggggctcctctgagagcatggcagcttctaatggacccgcgtggttagtttgagagaaacagtcaccagaagacagccatatgtgtccgggctgggagacctaacatttcagagccaccaaccctgcatcactggctgacaggtggctggacatcgtgtcaccactgtcttctgggaataaacatttctcagctttccaaaaaaaaaca

SEQ ID NO: 10091 - DNA, 313 bp, Homo sapiens
ccagactctgtgacatctccactcctgcctggttttcctccatgaccagcatccccccaggtcagcaacacctctggagctgaggctggcagaatgtggcgggggctcctctgagagcatggcagcttctaatggacccgcgtggttagtttgagagaaacagtcaccagaagacagccatatgtgtccgggctgggagacctaacatttcagagccaccaaccctgcatcactggctgacaggtggctggacatcgtgtcaccactgtcttctgggaataaacatttctcagctttccaaaaaaaaacactg

SEQ ID NO: 10092 - DNA, 499 bp, Homo sapiens
tttactaaggtagaaactgagggtcacctagcaagttagcaaccaaaccaagattagaactctagctttttgtattgctggttcagcacatcttactgccccagttgaaggctggattagttataactcaatcccgtggaaggatgtggttaatatcaaataggtggtggatcattgaaaacgttaaatgttgattctttaattagcacctcctcaatcattttggaaaccccaaagtacttagtgaactcaacaggtgtatggtgttcaggtcaggaaaaacagatctagtaattaactgtcaccatcaaaaggctgggctttcttaggtcaacatgaagactagctcccatttccactaccacctgcactgtaataatttaatagattgaaatgctgagaatgctttgggtaaatgtaaaaacatacagaaaggaacttgatttagtcctacccagaatcagaataataccctaaagagctcatttatcttaactga

SEQ ID NO: 10093 - DNA, 538 bp, Homo sapiens
gatgggatggtagggacagaaactgcagggtccgcagaaggaactgctcaccgaaagccaacaagcttgccctgtggaatcccagaaaggcccaggaacttcgggacatcactgaaggcagagtgaagagaggaagagaagacagagaaatggaggggagaaaactattaaaataagtaataagaaaactttccccagaagtgcagaatctgaatttccagtataaaagggtccattgagcgccaagaacaatgaaggaaaaaaggtcccactcaggcctatgtatcattgtgaaatttcagaactagagggataaagaaaagatcctaaaagcttcccgagagataaaaaagaagatttttacaaaggatcagcaatcagaattgcctcagactgctcaataaaaacatcagaagctagaagaaaatagaatgaggcgtcaaaatcctgagggaaatgattcccacctataatttcatattctgctcaattatcaattgagtattgaagggaaataaagacatttttagacaaacag

SEQ ID NO: 10094 - DNA, 440 bp, Homo sapiens
cccaaaaccttaaatccagtactagtgttcttttctcaccatatattttcaacacccatggaactgtaatcccattttcccactcaatatctcattacaaagatgttccattcaaatctgatccttcaacattaagcttaaagcgcctctggcttgtccatgtcaactctccccttgtcccctaaaagctacatttaagcacagtgtgtataaaacagttcgttgttttgggataaggagttccttaaagctacgtttaagcatagtatgtataaaacaacagtttgttgatcaaacttttgtttgttgctttatatatattgcaacagtttgttgttttatacatactgctcttaaacatagctttaaggaactccttaaggaatgggaactaagtgcaatgtggagctcattttttactgaatcattaccttttagta

SEQ ID NO: 10095 - DNA, 414 bp, Homo sapiens
atacccagagaggcagaaactttggctgccctcctcctaaaagccatatgaaatgaattgccaggaaccgtattttaacgtcctttcccttttcccttaacgttgaaagtcacaaactgtagtaaaatcaggaagaacgtaaaaatgctgggggccagcgctgggggtgggggactggggaggactgaggagggggccactcagtctttgaggcctgacttgatcttgataggtatttctcaggctgttagtattccgatgaagcttagctttactgtcaagtaaaatacaggaaacatttttttttaatgttgttctagttactgtaaatgaaacggttaaaatgtcataaataccttatgataaacatttttcaaatttgcttaaaaagcaacacatcagtaggcagggtat

SEQ ID NO: 10096 - DNA, 372 bp, Homo sapiens
aaaaaataattcttggcacctccagcctaagcataaccaaccacacataggctgtaagttatggatgaatatttatatttatggttttttgtttttttttttttttttttgagacaaagtctcactccattgtccaggctggagtgcagtggcgcaatctcggctcgctgtaacctctacctcctcggttcaaatgactctcgtgcctcagcctcccctgtagctgggatttcaggcgtatgccaccacacttggctaatttttgtatttttagtagagacagggttttgccatgctggtcaggctggtcttgaactcctggcctcaagtaatctgcctgcttcaacctcccaaagtgctgggattacaggc

SEQ ID NO: 10097 - DNA, 472 bp, Homo sapiens
attcgccggcccgcgtcgacgccctacagcacacctagactgaacgggatagcctatggcttctaggctgtaaacctgtacagcatgttactgtactgaatactgtaggcagttgtaacgcagtagcatctgtgtatctaaacatctaatcacagaaaaggtacagtaaaaatatggtatgaaaaattaaaaaccacacctgtttagtgcacttaacatgaatggagctttcaggactaaaagttgccctgtgggagttagtgaatgaatggcagattaatgtgaatgtgatggtctacacgctcaggctacactgtatttattaaaaaccagtaacaggctgagcggggtggctcacgcctgtaatcctagcactttgggaggcccaggctggtgggttgcctgagctcaggcgtttgagaccagcctgggcaacatggtgaaacccatctactaaaatacaaaaaaaaaa

SEQ ID NO: 10098 - DNA, 523 bp, Homo sapiens
ttatgggctattttttcattgtcaaaaggattcaaggggatggggtgctactggcatttcgtcaacctgggcgggatgctagacatcatgaaatgctcagacctcccgtactgtgaagaattcccaagacaacttttgaatgaccagctttatgtatatgaaaaccctgtttatctgagcctagaactgtctttgcacatgtaaacgtgaaatagcgtttgtgcgttttgaaaagactcagtttgctaggaattcattcccatgtaaattaagacgactttattttgcttggcaccttaaccaagagtttgtttgccattttgaaaatcgggttaccaacatcagagtcaccgataaagcaccaatatcagctggcattgcagctattgcaaccacagcaattctcatagggtgtgggattggactacttcattgtactttattgtcttctggtttagttgtgcttaagccttcacgtaatgaaatacatgttattataaattttattctttacagtgaagca

SEQ ID NO: 10099 - DNA, 445 bp, Homo sapiens
tagctcctgcctgacatgtgcagcatattgctaaacacatgtgagacattattgtagtgatatttcctatagaaaacaccttggtataattcaagatgaaaaatagaatatacatgagaggtgaaaaggcaactttgattagtaaagtgctgacatcccagttggaagcactgagaagtacattcaattgcctctggcttgctgaatctgtctatcccatacccacccccatctcacagggctaacagggaagcacattttgaaaattctgatgaatgcattccaattctcttttggtgggaaaggctgagtttgcagggaattggtagtaaagtattggcactttctttgtttctataatatcaataaattgcaaactgtcgtttcttttactgaacatgtgtttcaaatacagagctcatcattaagtcctgtcattttgtgc

SEQ ID NO: 10100 - DNA, 257 bp, Homo sapiens
gactcagtctaatctattagaaaaactggcatacagcaaagagaaattttagaaagagatatatactggatacaaaaattttacatcttactcaaataaattgggggaagggagctgaatggggatgaaggagagagaggaagaatataaacgtaatttacaaaatagctaacagaatcagactacctgatctgtggtacaaaatcataatgcttaatttaattgaaacaactctccctctcctcctagaaactatc

SEQ ID NO: 10101 - DNA, 270 bp, Homo sapiens
tctttccttctctctctcctacagatactaaatgctgctggaacaatgaaaagaaagaacggatgtcacaaaaagcattttcatttgatgaatagaactaaaagagcaaagcaattgaaagctcaacacaacacaggagggatccatggctgaggattgtatttcagaaccactgactgctcttgacaattgttaacccactaggctcctttggttagagaagccacagtccttcagcctccacttgataccaatacttaggaagaccaa

SEQ ID NO: 10102 - DNA, 798 bp, Homo sapiens
gatgacatggtccaataaatgaagttaaaaataacaggtggcaacctcaggcagcttcatcccaaccagtaagaaagtaaatccttttgtaaactaagaggaagtattaatatgggcgtttgagcaaacatttaagtgttaggacaaagaattaaaaactagcacaggcacccctgaagcatgataggatggcaacagaagggctgatttagtttccaagaaataacttacaggcagtgttgtgcgtgtgtctactacttaggaacccaaaacaaaccttcagaccgttttcatgagtactgagaccaagaaaaccactgggcagtgggtggtctggaaatgtaaatgttgatggtactccagtaatgagtcatggaacaatgtttcatattgaaaatgtttttgtaaatgtgggtttcagggtttcaaagtgaacccatatgtgttaggagaaaggacacaccaaagcagtaaaataattgggtcaatataaaaagtagaatattgcccagagagaagatgtggataatttctaatacggatcaaaggcaccaaaaaggtgagctgtgagtaagatattcagacctgcaccgtcccaagcagtagccacagtggcaagtagcctcctcactggacagtgcagctacggaatgatgccatcaccggaaagttccatcagccagcaccgatgcagacctttgcaactgcccctcacgctggacagcacctgtttgatagattgtccactacgcagtgaaaagcctgggtgaaaagcggtatttggtagaagagcaaaaa

SEQ ID NO: 10103 - DNA, 451 bp, Homo sapiens
tttcaggtcagatgggtaatgtgctgacattgtaacaaggtttgagggtggtacatctcacatatgtgtgtgagcacccaatcatcatgctcacgaactacagaaggatcaagccaaatacatttccgataaattacctagtcttaagtattccgttacagtagcacagaacagactgagacgcgttattctggcctatgtcccttggttgttgcatgacaggatgttcccttcactactgagagccgatgtctccttgtctcctgttacttcttaggcattagtaccttgaaagtttgccataaaatctcagttagggcctcagaagacagacacatgagataactaggctttagaaacactccacccccacacactcagctatgaaaacggtttgtttcctgctgctggaaatccacacattcctccttgccagtgtacacacaagcag

SEQ ID NO: 10104 - DNA, 438 bp, Homo sapiens
aactgccacatccttgttggtttagtccaagagatcatttgcaacaacagtagatgtccgggttttgtttctgtctttttattatgaaaaactatgttaagggggaaaatgtggattatggtaaccagaggaatccctagccttgttttccttagaagacttgtttagtgttttatcagacgtctgttgtagttgtagacaggaaagcttgtgagaaaaacaccacatggagcctgtaaatgtttttgcacaacctgtaaagcattcttggaagtggccagtaaaaaggggttttaccatttaaaaaaaaaatgtaactgtgtcattgtttacatctgtaactttttcctcccctgttctcattacaccattctggcgaaaatgtaggcaaagtagcttccagttttagaataaataaccatttggattgaattcacc

SEQ ID NO: 10105 - DNA, 350 bp, Homo sapiens
tctgttcccacctttagtcactagaagatgcagtgttgtcaccacttattagtaaatcacaaaacgaacatttataaagtccatgttttcttattcagaggagggaatggggttcattacttaagtctggggaaaagaagagatatcttgtatgggttaatccgaccatgagctccgattaacccatacatgagccttccctgccacattgagatgatccttactgaaaaggaacagattgttcctaaaccagaagaggaggttgcccagaagaaaaagatatcccagaagaaaccgaagaaacaaaaacttatggcacgggagtaaattcagcattaaaataaatgtaa

SEQ ID NO: 10106 - DNA, 419 bp, Homo sapiens
catttccttgctgtctacctaaggcaagctaactaactccttttagtccaccctcaggagtggagaccctaactgctgttagggagattttgtgttgatcttcctggccatgtcttcctggaaagggacattttgcagggagcagcagctaggatttcccctaggcctgatttaggggtccttggaagaaaggcatacatgcatggtgtggtcaaaatctaggataaaggtcaaccttgacacctctcaagtattgttcaattaaatgtgttatttttttctttttgaaagaatctttgatgtgataatcagagtagggaacaaaatttagtatctaaattttatgttagtcttccagtattatgtatgtgccactattatgtatgtgccacttgtttatcagtaaaggaaataataat

SEQ ID NO: 10107 - DNA, 433 bp, Homo sapiens
ttttattgtatataaattatatctcaattgaaatgtgaaaacaaagcaataaaacatcccctgttcccatttcaggagtcatgtctgggctgcctgggaggacaacaggaatactgatcgctagagcaaataaaagactcttggcagtgggcaacttggtcctcctaaggctttagaaattgtcttgctccatgaaaatgacatgttctgaggccccagtctggggtatactgactttcattagctaacgtcaccatccgtggtgctccctcacttgccaacactgcactgtagatttgactcccaagagcctaaggatagtctctgccaatcctccagtagccaccatcatagtagtttttacccccatcagtcagcagtccagtgtctactaacccctccattaattcacagcagttcttaccaccccttt

SEQ ID NO: 10108 - DNA, 747 bp, Homo sapiens
tgcattagtcaaggtctagacaggaaacagtcagtgtactcaaagggttaattaaaaactctttaatgaagggattattcacaatagtgtgagtagtaaaggaaacatacaagggatagtggagcacccagggactggcaaggtagtgtccccaccctaggtgcaatgacggagtggggatgtgtcactggaacccagcaaaagcaatggccatgggagagaggggtcctctaaaggagctgtgaccttggttaaggaacacagctctgccagaaccatatcctgggagggagagaaggcaaaaaataaacaccttggcctttcctcctgctcgctgatctcttcctggttctttcccttggctggactcagatggaagccagaggacctggagcccagggctttagagactgaccttctgactccagagacaaaaagcagggcagagaggatcaggtagggaaggaggagcagaccaagaatactgagcacacccacctgtcaaagtccaaactcttgagattaacactttacgccaccagttctggctcctactcaccttgctgacttgtcacccctgaaattaggacttttcatctttttatgtcccacagctccctcgttagctcctcagaaaaggtgagacattgaccagattagtattggttttgaacagtggatcagaggcaaacagtcacccccagagcagacagtggaaggaacttgcctggctcacactcatgagga

SEQ ID NO: 10109 - DNA, 268 bp, Homo sapiens
tcacaattcgctaacaatatgcattttcacaatgtaaagctgattttcctttaaccaaatcaaacatgaaaagatagctgcatgcaatgggcaatctagatcattagaagattgatgtaaaattagaggacactgagactggaatagattgcaaacttcagggagctcagaaaacttgtaaactctacattttgaggaaatatgttgtcgatgcttttgcaactctatgcagtaacttaacaaataaagccttaaagtaacttatcta

SEQ ID NO: 10110 - DNA, 923 bp, Homo sapiens
ccctataaaccacccagggtcacacaagggccatccacggtgaccagcggtgagaaacgcaatgctgtcctcgtgccatgctggaggtgaacgaggagaacgtgagctggggtctcctcaccaactgctccccccaccccaacccccctgacggccagggctgtgtccggggctcagggcacaaggctccgttagctgggcagcagctggcccatgaaacagccctttcagctccacctctgaatggcagttctatgggctcctcggaagaacacaggcgccttctctgtgtcacttctccgctcattagcagagctgcagaaatacactacaggactcaaaattgagaacagtgtgtccggtatgagccagaaggaaaaaaaaatgcacgaaggggccttctgcaaggttgctcacaagtcaaacaggcagctgtgaagggctctgctgttccctcctcctgttttcacatccctcgggcttccagaaacttaaagccgttagtgtttcatgcaagagagagcatctgtgatccacggagaggcccctgggcagtgtggttcagtgggaagcacacaggactccctccccagtgctcccaggatcagctctttccctaaagagcaaacctggttatctcgcaatgacctagctaacacaaatgcaacatcagccggggcagcctgcccccttcactctttgcccaccatcagctgtttggcagtatccatatacgcctttaccagtatttatttaatctttttgtttaattcactctaaaccaactcacttcttaaaaatttctctgccttataagaaataatagccatgaaatcactggtttgatgtacggtttatttatttattccaataaacactcattcaatataaaattcaaataaattcaaaactaattaaattta

SEQ ID NO: 10111 - DNA, 658 bp, Homo sapiens
  misc_feature (644)..(644): n is a, c, g, or t
aacaacaccccaaaatacgtcttttattgcacccaattttgatttctccaaactaagtgaggacataaagacacttgggaaacagccttcatgcagaatttgctattttaatggcccttgcccaccaaatcttttacatttatttcaggcacacctaattggacaaactttttgtgttggggggtggaaattcagctttgttgaatgcttctaaatcactccactgcgttttcatagaatcagcaactctttttttaacaatcatacttctgaattcagcaaacatggaattacgtttatgtaagcagcacacacaggcttgggaagaaacatggctgactttaggaagtagagcacaactgttgggagcacaagcgcccatttgtgctggtgagtagcagtcattggccatagcactgagtgtgccgtggacatcattcatgtgtttgacagagggaaaaggaaagggttagttgttgggtgatcagggtaagtggtgctccatttagagagcttctactgtactttggaaggaactacctgagtcagacaagtaaagatgtataacataataactggttaagaagaatgtgcattgcattctccatgcactatctttcctccagcctgggtgacagaaacanaattcgtctcaaaa

SEQ ID NO: 10112 - DNA, 389 bp, Homo sapiens
gcacaaaagaattaaaggagaaaactatagaaaaaacaatgaaagataggtaagtgagcaatattctggtgacttcttttgaagacatcaaaggataaaacttaccaaaaggccagaatctaaatagtcactttttcactttggcttttctgtgaggtcacatttccttttaatctctcacaatgatagggtatttgggtcataacacataaatattactggaatgactgatttcattaatgttcaaagacacaagcaacttagagcctactttagatagtttaaatctattttaaattgcatttgtaaaaattcactatgtttactacccattgaacatgcaaaaattcctgtgcagagagatttagaattaaaaaagtgtaataaaa

SEQ ID NO: 10113 - DNA, 591 bp, Homo sapiens
accttgttggccaggctggtatcgaactcctgacctcaggtgatccacctgcctcggcctcccaaagtgttgagattacaggcgtgcccccacgcccagccaaaagaaaatattaactactaactttgaagactcctagacatctattcccatttctatccccttttccttcagacataacaattatcctgagatttatgtttataattctcttgcttttctttatagtttcagctacttactccaaaactatgttgtttatggatgtttttgagttttatataactatttcatatatcattctgtgactcgcttttttgtcaacattatgttcctgagattaagtagtgtagctataatccattcatttttatgggtacagtattccattgcttgactatattacagtttttaaaatccattctcagttgatagaaatgtgagttgcttcaaagtttgaatttatagttctattacgaacattcttgtacatgtttactgatggacatgcagaggctgttctagggcaagggtcatcaaactttcttgtgcaaagggacatataggaaatattttaggctttgcgggcca

SEQ ID NO: 10114 - DNA, 422 bp, Homo sapiens
tgttggcaaatgcagatggtagcaagggctgtgggagacgtgagtgagtttcagtgacagagactagcagggctgaccgggtgacttctgcccagctctggtaaaggttggccagtctccagtcatactggtggactgtagtcagtttcacccaatgccccattgatggacacccagctcttgtccacggctgtgctacttcaaataatgctgcacaacagacattcttgtgcctacgtcttcgtacctttatcttaacatatctcaaaaggaagttccaggtatggaactgctggaactgtggttggatgggtttaaaatttgctggattcaataaatgatgctgaaggagtgtctctccccacagaggcccacgtgagaagtagccacaacttgtttgccctctaaggagccagaggaag

SEQ ID NO: 10115 - DNA, 839 bp, Homo sapiens
agggcggggtttgccctgggccgctgccggtcaggtcggccgcccctgacagctccgggagcctcaagcgcgatcagcggcgccctcacctcgggacatccacacaccgaccgctcctgctccagaggcaacaacccagcgcgcctagcctggcgccgtgcagcgaagcccaagagctggcctcgccacgaaggttgaaccagccaaattttcgagacagctcacggcttagaggaaggttcatctaaataaaggccggctaaagtgacattgcagggattaaatccttctttggctgcctgtgtgaccagaaggcttatttgcaagtttcttctttcctggggtccagattattaggtctccagcgccctgcagcttgacagaaagagaagcatgaaatgaaggtcagagatgagatcccgcagcagggacgtgggggcctcccaggggcatttacgcaccagagtgcaagattctctggccatcaagggaaatagcaaacagaagcctttgtcctggggcacagcacctaccacaaagcatcagactccacgtctggccagaaagttcctggagtcccatcaggccagtgggtatgtaacatgtgcctaattgtacagctagagcctgcaagttcaacgtgagggaaggtgggaaatgtcttgagtgaggcgagcagctcctggctgggctgggcagactcagctaccacgttcactgccttcctcttcactaaagccgagagggaggctgctcagctctcaggaaaactctttttgaaccctggggcacctgctgtcctcagtttggcatctcccaccctttgagcctcttctgct

SEQ ID NO: 10116 - DNA, 690 bp, Homo sapiens
ggaaaatgattttctttgtaaatatatagcatcgtgtttggtttgggatgtagagtctatacctggctgctgattgcgtcgtttactacagctttttttaaataagatttttgctttaccatttatcataatgtagtaatgaagcaaaatggtcaaaactgggtgtgtgtgaacagagatacacccatattcgtgtatatacacatccacctacatgttttggtctgtggtttaagagactatttcaaggttccatttttataagctaaaacattctaagttaagatggaagaaagccctaaacacagtagattctgagtttttatgtgtattttaaccagagtttctgatagtactgtatctggctacctatatttccagatctaaagcaagaactactctaagtactgcatttggaatcctcctccattaggaatggccaggacaagtggagctagccattttcattacacggccatcccaatggacactggatccctggtccaactgtgtagagcggggactataaacacacatcaactttctttctgtttgctttcttttccttcttttcaaactcttaaactcaggcctttatgctgtgagtgactagtccaagaagcacacattttgtagtagtcctgcaccagccctgctcttgaataaaaaggaaaattactggctgcaccc

SEQ ID NO: 10117 - DNA, 744 bp, Homo sapiens
ggaaaatgattttctttgtaaatatatagcatcgtgtttggtttgggatgtagagtctatacctggctgctgattgcgtcgtttactacagctttttttaaataagatttttgctttaccatttatcataatgtagtaatgaagcaaaatggtcaaaactgggtgtgtgtgaacagagatacacccatattcgtgtatatacacatccacctacatgttttggtctgtggtttaagagactatttcaaggttccatttttataagctaaaacattctaagttaagatggaagaaagccctaaacacagtagattctgagtttttatgtgtattttaaccagagtttctgatagtactgtatctggctacctatatttccagatctaaagcaagaactactctaagtactgcatttggaatcctcctccattaggaatggccaggacaagtggagctagccattttcattacacggccatcccaatggacactggatccctggtccaactgtctaaaaggccagttgttcctttctgtggatgtggatgtctggccttcacctgaggtagagcggggactataaacacacatcaactttctttctgtttgctttcttttccttcttttcaaactcttaaactcaggcctttatgctgtgagtgactagtccaagaagcacacattttgtagtagtcctgcaccagccctgctcttgaataaaaaggaaaattactggctgcaccc

SEQ ID NO: 10118 - DNA, 689 bp, Homo sapiens
ggaaaatgattttctttgtaaatatatagcatcgtgtttggtttgggatgtagagtctatacctggctgctgattgcgtcgtttactacagctttttttaaataagatttttgctttaccatttatcataatgtagtaatgaagcaaaatggtcaaaactgggtgtgtgtgaacagagatacacccatattcgtgtatatacacatccacctacatgttttggtctgtggtttaagagactatttcaaggttccatttttataatttttatgtgtattttaaccagagtttctgatagtactgtatctggctacctatatttccagatctaaagcaagaactactctaagtactgcatttggaatcctcctccattaggaatggccaggacaagtggagctagccattttcattacacggccatcccaatggacactggatccctggtccaactgtctaaaaggccagttgttcctttctgtggatgtggatgtctggccttcacctgaggtagagcggggactataaacacacatcaactttctttctgtttgctttcttttccttcttttcaaactcttaaactcaggcctttatgctgtgagtgactagtccaagaagcacacattttgtagtagtcctgcaccagccctgctcttgaataaaaaggaaaattactggctgcaccc

SEQ ID NO: 10119 - DNA, 293 bp, Homo sapiens
ccttattttcaaaaaatctttagaatttcaaatattattatagttcatgtaaatatgtagatgaagaatagttgtattcttccttcttcctattttgtagcatactggaactaaaataataataagatatgacactaatatctttctgaaaggcaaattgaattaccaattctaaatattttcttttttgatatagtggcatatggtacatcaacttacatatctaagtataaaattcacatttcagagtccagatatttatgtaggttcttgaatgtttcccttttatcttg

SEQ ID NO: 10120 - DNA, 635 bp, Homo sapiens
ggtgccaggtgttactcccagggccacccgtaactgtgaatgtgcaggaaccctgattaggccctgggaatgagagtttggttccggtaccagggaaaccaccagcatcggcagaggtgatagctggggaggagcggggatttggacgagagacacaggatgagtaccgggggcagccctgtgatcaacaactgctgcaagaggggccgtttgttcgactcactagtcttctgtggctctatgcggtactaaagagcagaagacagaagatacaaaaaccacaaaaattagccgggcgtggtgctgcgcgtcaataatcccagctactcgggaggctgagacgggagaatcgcttgaatccgggaggtggaggtttcagcgagctgagatcacgccattgcagtccaacctgagcgtccgagcgagactatctcagaaagtaaagacagaattaaagtgcccagcgcagtggctcacgcctgtaatcccagcgctttgggaggccgaggcgggcagatcacctgaagtcaggagttcgagaccagcttggccaacttggcgagacctccttaaaaatacaaaaattagctgggcgtggtggcgaacacctgtaatcccagctacccaaggaggct

SEQ ID NO: 10121 - DNA, 617 bp, Homo sapiens
caatgcctagtcacctcagattttcctgtacctgcaggtatcaccagtgaagcctgcgaagcagcaaagatggcagtctgccccgtcttctaggagctctgtcacagggagacaagccgtgctgtgctggcggaccacttcagctcatggtcacctcagacactctgaagcctgaaggctggaacaactaaattgcccaaacagcaaatatgacagcatctacagaaatcattttatttgagttatgtagcaagaacccaacttaagcaaatataaaatttacaactaagtcactatttggatattaatgtgtatgctaaactgatttgttcatgggctagtcagctattcatatgatctttacaattttctgaattccattttttggttaaaaaaagaaaacaagctgatacttttatcactttctaagaaacatttgatttaaattcttatgccttcaatatctcatgtaaaatgctagtttcattactactgtaagtaaatatgtgtaaaacagaaagtatctgagacaagtctcaatcagttttgaagtttatttggccaaggttaaggatatgcccagaagaaataaacatgcaatcacagaaacagtccct

SEQ ID NO: 10122 - DNA, 278 bp, Homo sapiens
taaatgaggataatgactatacccaggtcacaaggctgttttgagaattaaataaattagtctgatctatatgaagtacttagaatatgcctggcatggaacgttacttgtattcattatttcagatcctaatcataaattatttaaaaaattccatgtatggccaggcacggtggctcacgcctataatcccaggactttgggaagccgaggtgggcagatcacctgaggccaggagtttgagactagcctggccaacacggtgaaaccctgtctct

SEQ ID NO: 10123 - DNA, 437 bp, Homo sapiens
cttcggttcttgatggagatcagaaaaattgcaagagacttcatcatctgtttacatatacttaggcaccgtcttatgttgatattgtagaatgaagaaacataactcagtcacaaaagcatccaaattaaaggcctacaacttgcacttgaaaaaccaattatgagctgcaacaacagacctaacaagttaaacaaataaaatataatgatttacttcctcctggagatgatgtgagactaaatgagaaaaattccattaagtactctttgaacatgtcatataaatgcatgatattaacagccatcattattttcccaacattttctggctcattaatttatatctggatttcaaaagattaatgcaccatttttaattttaaaaagacatgtgaaataattatttttaaaattaaattgatataaattcgtgaa

SEQ ID NO: 10124 - DNA, 1188 bp, Homo sapiens
gtgagctttttgtgccccgacagcgagtggttgtcaccccaggccctggcgaggggggcacgtgtctctgtcacgtgaatccctagtgggggggggtggcacaagactgtcacgcgaggtctgaggaagggggtggcccaggccccaggtcgggggttcttgtcgggcgctgggcctgagtgagcagtaacaaaggtgcactcctgaccctgcctggatctggggaaaaccctctggccacggggcctccacctcctccccggagaggcaggaggaggggcaggaggggggcaggacgggcccgggggggggctcccctcaccgaggcgcgtggacaggggctccgttcctgtgaagctctccctgacatgcatcttcgtctctccatcctggctttggatctagaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacaaaaaaaaaaaa

SEQ ID NO: 10125 - DNA, 2046 bp, Homo sapiens
ggaccgcgccccctcctcggtccccgcgccccgcgagtccgcgcagttcccgaggcgcgggccctgttccctgcgccgcgccccctcagcgggccgtgctcgcatcaccgaggtcggtccggggcggaccgaagcccccggggcggggcggggcgcgggcgtccgggggcgccgcgggccagcccccgccatgccgcccggcaaagtgctgcagccggtcctgaagatgaaggtggacgagctgttcctgtactggctcagcgaggccagcacgcagcggatgctgaggactgcctgcgccggatcaaggcgcccgggcgggaccagccgaccccgggggacggggagcagcccggggcctggcccacagcccgtcgcgccccggccagggtcgaacccccgggaacccccgggccgggccctgcgctgcccctgggcgccgctccagccccaggaacgcgccccacgttcgaggcacccgtagatccgcaggacgagagtagttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacaaaaaaaaaaaa

SEQ ID NO: 10126 - DNA, 1776 bp, Homo sapiens
aaggaggagaggagagcagcgccgggagcagccgggtctgcacagtcgcgggtcgggagagcgcggcgcccggcccggcccgcggagagccctgcgcgccggcggcatgcgactccgcgagcgctcgctgcgccaggaccccgacctgcgccaggagctggcctcactggcccgcggctgcgacttcgtgctgccctctcggttcaagaagcggctgaaggccttccagcaggttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacaaaaaaaaaaaa

SEQ ID NO: 10127 - DNA, 1590 bp, Homo sapiens
atatcagctcggaccttattccgcgtagatccgcaggacgagagtagttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacaaaaaaaaaaaa

SEQ ID NO: 10128 - DNA, 1330 bp, Homo sapiens
ccggggtggccgcacccccttcccacctgtcctgggcccgtgtagctccggggcgtccccggccagaccctccccgctttccgcggcctggggcggcgcctcccgcagggcccttccctctgcccccgcctgtgccctggcggccccgtgcggctgagaccaagggcgcgcccctctcccggctcccggtctccgtgcggggcgaggctcctgggggtctctgcgcacccaccgcactgacagcgcccccgcaggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacaaaaaaaaaaaa

SEQ ID NO: 10129 - DNA, 1481 bp, Homo sapiens
cagcttgtcaccagcaagacatttactgttcacaggtctgcaggctggaagatctcggtgtggcagagtggtgcctggttcatcgacggcgccttcccgctgcgtcctcacggggtggaaggggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacaaaaaaaaaaaa

SEQ ID NO: 10130 - DNA, 1503 bp, Homo sapiens
agatgcccggacaggccgcgctgagcgtgctgtgtctttctgcagcagagggtctctgggcggcgtcggtcaggcgcgaggtacgcagcaggagcgccggcgtccaggccctgctgactgcccactcctgccctctctgccccaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacaaaaaaaaaaaa

SEQ ID NO: 10131 - DNA, 2352 bp, Homo sapiens
ggaccgcgccccctcctcggtccccgcgccccgcgagtccgcgcagttcccgaggcgcgggccctgttccctgcgccgcgccccctcagcgggccgtgctcgcatcaccgaggtcggtccggggcggaccgaagcccccggggcggggcggggcgcgggcgtccgggggcgccgcgggccagcccccgccatgccgcccggcaaagtgctgcagccggtcctgaagatgaaggtggacgagctgttcctgtactggctcagcgaggccagcacgcagcggatgctgaggactgcctgcgccggatcaaggcgcccgggcgggaccagccgaccccgggggacggggagcagcccggggcctggcccacagcccgtcgcgccccggccagggtcgaacccccgggaacccccgggccgggccctgcgctgcccctgggcgccgctccagccccaggaacgcgccccacgttcgaggcacccgtagatccgcaggacgagagtagttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacggtctctttctccgtctgaaagctgtacctttgaggcctgaatattctgctctttacaagtcggtcttggagccgcggtcagctttgcgctctgtggatttcatgctggacttggctctgctcgacgggaaagcgtggtgggcccctaggatgggccgtgcaggggcatcggggccccggggctctcccagacccaggcgtcctctcagcttttcggtccccaccgcatctagtctcggctccggggggtggtgacgtcggggccgaggcacggtgcgggctgcccatcaaccgcattcctttccagccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacaaaaaaaaaaaa

SEQ ID NO: 10132 - DNA, 716 bp, Homo sapiens
ctctctccacactggccacactggtttttaatatattcacaaagttgtgtaatcatcaccactatgtaattcctgaacattaggctgcgtgcagtggcttccctccttgggtctctggcagagtctgagaattaggttgacatagaataacaggagaaaagcttacgaatgttattttatttttttgagacggagtctcactttgtcgcccagtgtggagagaggcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcggccgaggagtacgacatcctggtggccgaggagaccgcgggagagccctgggaggacgggttcgaggccgagctcagccctgtggagcagaagctgagtgcgctgcgctccccgctggcccagaggcccttcttcgaggcgccctcaccgctgggcgccgtggacctgtacgagtacgcatgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacaaaaaaaaaaaa

SEQ ID NO: 10133 - DNA, 2172 bp, Homo sapiens
ggaccgcgccccctcctcggtccccgcgccccgcgagtccgcgcagttcccgaggcgcgggccctgttccctgcgccgcgccccctcagcgggccgtgctcgcatcaccgaggtcggtccggggcggaccgaagcccccggggcggggcggggcgcgggcgtccgggggcgccgcgggccagcccccgccatgccgcccggcaaagtgctgcagccggtcctgaagatgaaggtggacgagctgttcctgtactggctcagcgaggccagcacgcagcggatgctgaggactgcctgcgccggatcaaggcgcccgggcgggaccagccgaccccgggggacggggagcagcccggggcctggcccacagcccgtcgcgccccggccagggtcgaacccccgggaacccccgggccgggccctgcgctgcccctgggcgccgctccagccccaggaacgcgccccacgttcgaggcacccgtagatccgcaggacgagagtagttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacggtctctttctccgtctgaaagctgtacctttgaggcctgaatattctgctctttacaagtcggtcttggagccgcggtcagctttgcgctctgtggatttcatgctggacttggctctgctcgacgggaaagcgtggtgggcccctaggatgggccgtgcaggggcatcggggccccggggctctcccagacccaggcgtcctctcagcttttcggtccccaccgcatctagtctcggctccggggggtggtgacgtcggggccgaggcacggtgcgggctgcccatcaaccgcattcctttccagccctttctaccaagatgatagacaggatcttctcaggagcagtcacacgaggcagaaaagtgcagaaggaagggaagatcagctatgccgactttgtctggtttttgatctctgaggaagacaaaaaaacaccgaccagcatcgagtactggttccgctgcatggacctggacggggacggcgccctgtccatgttcgagctcgagtacttctacgaggagcagtgccgaaggctggacagcatggccatcgaggccctgcccttccaggactgcctctgccagatgctggacctggtcaagccgaggactgaagggaagatcacgctgcaggacctgaagcgctgcaagctggccaacgtcttcttcgacaccttcttcaacatcgagaagtacctcgaccacgagcagaaagagcagatctccctgctcagggacggtgacagcggcggccccgagctctcggactgggagaagtacgcgtgcggggacgaggacctggagccgctgtgacgccgcccgcgagaacgccgccgcggggccgctccccacgtgccaccaccgggccaccgcggctcgtgtaaaaactgttgtggaaaatgagtgcgtttgtacggaatgataaacttttatttattcacaaaaaaaaaaaa

SEQ ID NO: 10134 - DNA, 1034 bp, Homo sapiens
ggaccgcgccccctcctcggtccccgcgccccgcgagtccgcgcagttcccgaggcgcgggccctgttccctgcgccgcgccccctcagcgggccgtgctcgcatcaccgaggtcggtccggggcggaccgaagcccccggggcggggcggggcgcgggcgtccgggggcgccgcgggccagcccccgccatgccgcccggcaaagtgctgcagccggtcctgaagatgaaggtggacgagctgttcctgtactggctcagcgaggccagcacgcagcggatgctgaggactgcctgcgccggatcaaggcgcccgggcgggaccagccgaccccgggggacggggagcagcccggggcctggcccacagcccgtcgcgccccggccagggtcgaacccccgggaacccccgggccgggccctgcgctgcccctgggcgccgctccagccccaggaacgcgccccacgttcgaggcacccgtagatccgcaggacgagagtagttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtgggtccccagcggaggggccgtcggttccagcgcggggcgcgggtgtttctgcagcagccgc

SEQ ID NO: 10135 - DNA, 1482 bp, Homo sapiens
ggaccgcgccccctcctcggtccccgcgccccgcgagtccgcgcagttcccgaggcgcgggccctgttccctgcgccgcgccccctcagcgggccgtgctcgcatcaccgaggtcggtccggggcggaccgaagcccccggggcggggcggggcgcgggcgtccgggggcgccgcgggccagcccccgccatgccgcccggcaaagtgctgcagccggtcctgaagatgaaggtggacgagctgttcctgtactggctcagcgaggccagcacgcagcggatgctgaggactgcctgcgccggatcaaggcgcccgggcgggaccagccgaccccgggggacggggagcagcccggggcctggcccacagcccgtcgcgccccggccagggtcgaacccccgggaacccccgggccgggccctgcgctgcccctgggcgccgctccagccccaggaacgcgccccacgttcgaggcacccgtagatccgcaggacgagagtagttcagacacggaaagaagagcctctgcccccggccacgagccaaagcattccgaccttctacttccccagaggacgcccgcaggactccgtcaacgtggatgccgtcatcagcaagatcgagagcaccttcgcccggttcccccacgagagggccaccatggatgacatgggcctggtggccaaggcctgcggctgccccctctactggaaggggccgctcttctatggcgccggcggggagcgcacgggctccgtgtccgtccacaagttcgtcgccatgtggagaaaaatcctccagaactgccacgacgacgcggccaagttcgtccatctgctcatgagccccggctgcaactacctggtgcaggaggactttgtccccttcttgcaggacgtggtgaacacgcacccggggctgtcgttcctgaaggaggcgtccgagttccactcgcgctacatcaccacggtcatccagcggatcttctacgccgtgaaccggtcctggtccggcaggatcacctgcgccgagctgcggaggagctccttcctgcagaatgtggcgctgctggaggaggaggcggacatcaaccagctgaccgaattcttctcgtacgagcatttctacgtcatctactgcaagttctgggagctggacacggaccacgacctgctcatcgacgcggacgacctggcgcggcacaatgaccacgccctttctaccaagatgatagacaggatcttctcaggagcagtcacacgaggcagaaaagtgcagcagcagggaaggatcagtatgccgatggtcggttcgaccctggaggagaaaaaaaacaccgccagtctgagtaacggtcccggcgtggaccggaggggaagggccctggccagttcgagccgcgtattctacaaggaaggcggaaggtgccacaaggacggaggcgcgcctacaggagcgcgcaaagtgccgggaacacggag

SEQ ID NO: 10136 - DNA, 501 bp, Homo sapiens
gcggccgcccccacccccggcgccatgcgccctcctcagcctgaggaatgcgcgcggcgcgggccccggccccagagcgcctggcgggcgacgcatggagcgcgctgagcccgggccacgcctgcagcgccccgccggccccggcccggccctgccccgagagcgcggcgcccggcccggcccgcggagagccctgcgcgccggcggcatgcgactccgcgagcgctcgctgcgccaggaccccgacctgcgccaggagctggcctcactggcccgcggctgcgacttcgtgctgccctctcggttcaagaagcggctgaaggccttccagcaggtcagccccgcgcgccccgcggctgcccgacaccgggcgaggcctcccggcccggcgagccctgccctcccggccccgcgtgggcccccgctcgccgctgctggccgtgcacccgttgttgcgtggcggggcccaaacgccagatttacagggccagttgtgggcgc

SEQ ID NO: 10137 - DNA, 1169 bp, Homo sapiens
ggctggggcgtccccgtggtacggccccaccggccgtaaacaccggggacgcgcgccgacaggcggagagccagcttctgccttaaagatcacccgagagctgagaaacgtgttgccaaaagaaattgcacaaaaatagtcgcactagtgagctctgggtggcggggtgattgtgagcagtttttacgggctaccgtggctcctgtttttcacaaagtattaacaggtgggtttaaaacgtcagggagcacacaaaacactcagagaagccgaacaggcgccccggggctgccgggagggagacggaagctggcgggacagcgcccttcagatggcgcggtacgctgtcgatgagacctcaggtttttaaaaacagtctttaaacttcgaccctacaccataaggactacgtcgggtcaaaattacttctggtcagccgcgggccccaggtcccagggctgagcaagtccggtctgcgacaacacgaggctctcccgtgacggggcctagcccaaggctccccccgcagatctcctgggattcagaactaccaaatcgccggcagacagatctccatcagaggaagcctgtgacggccgccaggataaaataaaaaggacaatggcaagtgatagcaaagacgtagagaagctggaattctcctaaatccttggtaggagtgtaaaatggtgcagcttcttctataattcagcatcccctaccatactccctggaacccacccaagagaaatacgaccagagagacttgcatgcaaacattcctaacagcattgtccacgccaaccagaacgtccaccaaccgcggatgcatgagcagcagggaaatggccatgaaaagaaactgctgagacatgggcctacatggatgaacctcaaaaacgctaggccaggtgaaagatgccagacaagaaaattccattattccatttatgtgacacttcttaaaaaggtaaatctctagagaggaagcaaattcatgtttgcctgggggtgagagtgggatcaactgcaaacaggcacgaaggaacttttttgggtgatgaaaaataaaactttggatgtcgaacatattttgaaactagattgcaatgatagttgcataactgtatacatttattaaaatcgtggaacacttacaaaaaaaggat

SEQ ID NO: 10138 - DNA, 282 bp, Homo sapiens
gtaaaggaaaggaggaaaataggaaactatctttaaggatcctgaatgagaggggagaaaatggaaagggtatatgtcatcaacacctagaagctttcctatgtagggaggccgacaaatggaatggcagctgaagagggggataggactagtcaaatgatggttttttaaaatagatgggagatagttggaacctgtttttgtgtgtaagtaggaatgatccagtggagaagaggaaattggtataggagagtagaagccaaaagagaagggatgtagagc

SEQ ID NO: 10139 - DNA, 484 bp, Homo sapiens
tctggaagcaggtaggattgtttcccgattcaacagatgggggaactcaagtttagaaagggaaatgacttccccagggtcacataggagatagcagagccggcacttggactctaaactttccattgtcacgctctgcagcaggtcctgaaaaccgaaacacccacaggcaggtaaagtatacaacggaaggaggccaggcgcggtggctcacacctgtaatcctcagcctcccaaagtgctaagccgccgcgcttggccacgatgattaggtttttatgcacgtgtgagagatacgcctcccttaaaccttgttgcgaccttggcgcattacctgtctgatatgaaaaaataagacccggctcatggtggctcctgcctgtaatcccagcattttgggaggctgaggcaggaagactgcttgagcccaggagtttgagaccagcctgggcaaaatagcgataccctatctctataaaaagta

SEQ ID NO: 10140 - DNA, 485 bp, Homo sapiens
tctggaagcaggtaggattgtttcccgattcaacagatgggggaactcaagtttagaaagggaaatgacttccccagggtcacataggagatagcagagccggcacttggactctaaactttccattgtcacgctctgcagcaggtcctgaaaaccgaaacacccacaggcaggtaaagtatacaacggaaggaggccaggcgcggtggctcacacctgtaatcccagcactttgggaggctgaggcaggcggatcacgaggtcaggagatcgagaccatcctggctgacatggtgaaactccgtctcactaaaaatacaaaaaattagctgggtgtggtggcgggcgcctgtagtcccagctactcggtgggctgaggcaggtgagtggcgtgaacacgggaggcagaggttgcagtgagccgagatcgcaccactgcaatccagcctgggcaacagagtgagactccgtctcaaaaaaaaagc

SEQ ID NO: 10141 - DNA, 512 bp, Homo sapiens
gctgagggaattacttattgaaccaaaatatgttcaaaatatggcatgtcacacatagaagagtgaggtgtgcatatataactggaagattacaaatggcctattgaaaaaaagaaaatagtgttaaaagtataaagctattaaaaaaaagtaaatgtccccatacccaaggagagagacgtactaactagaagtcgaagttggcattctcctttattgtcctcccatgcacccataaaaaccaggcactttatcttggtatggtagcatgcctgtaataccagctcctcaggagactgaggtgagaggatcacttggtccctggagtttgtgaccagcgaacagtgatcacaccactgcttgccacgctgggcgagagtgagatctcaaaaaaaaaagcaaaaacacaaaagtcacctgtacgttgtgagagataccacaccaaactttgggtggcctcagaggtcagataatagagactgaggtgagggactagtaattgttcttattta

SEQ ID NO: 10142 - DNA, 280 bp, Homo sapiens
gaaaggctggaaagggaactagtttctgggatttgcctggaacttcccttggacattactagcacattctggaaaaaaagcaagttgaacatatctaccatcagtcctctcctacttccttcccaccccaccctatccactacccccactgatgctatgtttgcatcatcaaagtcaggggaattgagaaaagagattatcaaaataaattattaaaatccagaaaacagttttatgtgaagtaattcaggaagatctagtgttcattttgcatggattg

SEQ ID NO: 10143 - DNA, 556 bp, Homo sapiens
  misc_feature (91)..(91): n is a, c, g, or t
  misc_feature (109)..(109): n is a, c, g, or t
taattttgaaatagggctttaaaaaagatttggtagtcaatttccaagcatgcctgtactttttgatatctcagaataatttatacgtagncaatttcttttttgtttngtttttttgagacggagtccagcctgggcgacagagcgagactccacctcaaaaaaaaaaaaaagaaagtttacgaatttgtgttgggttggattcaaagtcgtcctgggccatatgcggtccacaggctgaggtttggacaagtttggtgtagagaatgaaagggatgaggcctttgctccagccttggagccattgatcaggatagtttttagagtgtacctctttgcttaaaaggcagagggtccaccctgggcaacatagcaaggccccacctacaaaagaactacaaacaactgggcgtggtggtgcactcttgcagtcccatctgcttaggagactgaggcaggagcattgcttgggcccgggagttggaagctacagtgagccatgattacaccactgcactccagcctgggtgatagagggagactcctcaaaaaaaaa

SEQ ID NO: 10144 - DNA, 418 bp, Homo sapiens
acccaggatggagaagggcagcacctgcgagtgtttgccccttggggagtcgagggcagaacctccctccttccttgcctggctttctgcagagcccctgccctccccaaggagcacagacccaggctactccctgggaccttgggagggtcacctgcagcccttctggagaccacagggaccaataacatgccacagtgacctcaggccatgcatgcccattggaggaccctctgcatttttagaaaaacacagatgtctttgaaagcaccaatcctgcaaacactttgtatatccttgcaaatcgggtaaaagaataattttctccaaatctatacaaatcctcactcgtccattcacctttgccatggaattcaccggcaaccccctctgaggaatgcacgtgtcaatgcagaaa

SEQ ID NO: 10145 - DNA, 689 bp, Homo sapiens
tatatttctgagttttttaagttttgggtttttctacacatttgctactgattagaaaaagatatatgaaatttcagagaaattatggaatttctggaagatgaagttattaccagaagccaatataggccaggcacagtggctcacgcctgtaaccccagtactttgggaggcgaaggcgggagaattgcttgagtccaggagtttgagaccagcctgcgcagcatggtgagatcccatctctacgaaaaattaaaaattagctgggcatggtggcttgtacctgtagtcccagctacttggaaggttgaagtgagaggattgcttgagcctaggacatcaaggctgcagtgagccatgatcattccgctgcactcagcctgggtgaaagagggagaccctgtctcaaaaaaaaaaaaaaaaaaaaaaaaagctaaattgagctatctacattttattgctaggaaacctaccagtttttttaaacactaatataaaaccttaagacttagatttttgtttgttttaaacagtaaatatataccattctcctaggaaagaattacaactctttattcctttttactttgcgtagtatataactccccagctaaccacaagttcacttcttttagaacaagtgacattattttcttgccttattcattctagctcaactgaaacacagg

SEQ ID NO: 10146 - DNA, 319 bp, Homo sapiens
gactaaataaacttttaaatgcatggaaatttgagtatttttaaatatatagagattataaacaagtttcttaaagacaagttaataggaatatataataactcataatttcaagagccacgactttaaaagtagctgctcttctgaaaaataagcaaacctttatccattgtattttattacaagatactatagaattttaaggtataaaggattataaagtttacctagttcatcctcttttgtatattcaaaatatattcaaataccttgcagaaattcatcatacaactagtttagtttccaattgcttatttct

SEQ ID NO: 10147 - DNA, 410 bp, Homo sapiens
tttacacacgtggacccggaagcccaggggaaggggaataccttccagctgatgcatccccacctggcacacagtctggtttttttttttgagatggagtctcactctgttgccaggctagagtgcagtggcgcgatctcggctcactgcaacctccgcctccgggttcaagcaattctcctgcctcagcctccatagtagctgggactacacgcacgtgacaacatgcccggctactttttgtacttttagtacagacggggtttcaccatgttggccagaatggtctggatcacttgaggtcaggagttcgagaccagcctggccaacatggtgaaacccgtctctactaaaagtacaagaattagccaggcgttgtggcaggcgcctgtaatcccagctacttggga

SEQ ID NO: 10148 - DNA, 346 bp, Homo sapiens
taattttctttttctgaatgattaaacatagacctacttcactgtggagtttaatttttgttttatattattttttaagccccttccattctgggatcactgtggaattttataacagtgtacttgctgagaaagttaattgatcttgataccagtcgcaaattgggaataaatgtagataacttttggtccaagttttaaacttatatacacaaatttacatttttgaaaattggtgaagcaatatgaattttttgtctgtgcaagagagccaggaagttgatgctgatttgttctgaacttttccacatgaattaccactggtttaaagagttattgattctca

SEQ ID NO: 10149 - DNA, 545 bp, Homo sapiens
agacctgggtggagcggtggaggtggtgatgcgttgtcaaattctggaggagctgtgaaaggtgagctgccagaatgtgcttccaggttggctgtggaggtgagagagaattagcttgactccaaggtttctctcttgagagatggaagggatgaagctgtcattcacagagatggagagaggtcatcggcagagcaggcctgagggagatgcttgagatggccgctgttgagctaaggagaggtgttgagcaggaaactggaaatctaggtctggaggcagggagaggcagctggaaatagcaatctgggggtccggccgggcatggtggttcacacctgtaatcccagcactttgggacggtgaaaccctgtctccactaaaaatacaaaaatcagctgggcatggtggtaggcgcctataatcccagctactggggaggctgagacaggagaaattgattgaacacgggaggcagaggttgcagtgagccaagatcgccccattgcactctagcctgggcgacagagtgagacttcctctgg

SEQ ID NO: 10150 - DNA, 402 bp, Homo sapiens
gttcttggacctgatggagaggtagtagacatcagttagcgtagagatatctggctaggcttttcagattctttttggtcaggcttttccaattctctttcatcaggttaaactacaacagatagacctaaagaattcttatttagccaggcacagtggtaacgcctataatcccagcacttttggaggctgaagtgagtagatcatttcagcctaggagttcgagagccgaggagttcaagaccagcctgggcagcatggcgaaaccctctctctacaaaaacaatacaaaaattagctgggcatagtggtgcacacctgtagacacaactactcaggagcctgaggtgggaggatcacctgagcctgagaaagtcaaggctgcagtgagctgtgattgca

SEQ ID NO: 10151 - DNA, 330 bp, Homo sapiens
caaggtggctcacacctgtaatcccagcactttaggaggctgagacaggtggatcacttgaacccaggagtttgagaccagcctgagcaacatagggacactctgtctctacaaaaaatacaaaaattagcttgacatggtggcacccacttgtagtttcagctacttgggaggctgagggtggaggatcgcttgagccaggaggcagaagttgcagtgagctgggaatgcaccactgcactagagcctgggcaacagagtgagactccacctcaaagactctctgtatatagatagaacagaaatattcagccttatttaacacttctt

SEQ ID NO: 10152 - DNA, 116 bp, Homo sapiens
tcacactttaggaagcaagttcgatgtggtttctattttacaaaatttaaatcagaatcactattattataccacatataattataatgacaatgatgccaacagataaaagcttg

SEQ ID NO: 10153 - DNA, 353 bp, Homo sapiens
aagcaaaaggaaagttcagtgcaaactgggcagttgataatatcacagtgaaaatattagaccaatttgtcctctaaggaagattgaaaagggcagatttttttttttttagggatatataagaaagctgaagataagtagaatgcacttgctctaaatctgttgttcccaacctgtgagcttcagaggttgagggtggagggatggtaactgactcatggtaagcacttaatgaaagtttagtttttgaatggcttaatgaatgcttcttcttgtcttggttgggggtggatgggagaagtgattccagttgcattggtacttcctgctgcccggcacaggaagccttctct

SEQ ID NO: 10154 - DNA, 426 bp, Homo sapiens
tcactgccagccagaagactttggatagcccctctgggaagctgtggcatgacgatcacaggtctctccagaatatcatccccgcatctactggtgctgccaaggctgtgggtgaggtcatccttgcccaaatgcaaggaccctataaatccccaatggaataaatcctctggaagcactttcctttcttatggcactctgcacatttactgtgcacagcacctaacatgtctcatatttcatctcccccactggaccactaaactgggagcagaaatggaaaattggaagtattagtcctgggtccagcctgcagacttgttttgttagtttgcatgcttttccccccacaaagtttaatttatttaaaaaattataacctatgataaacatacagaaaatttgagaaaatggtataataacata

SEQ ID NO: 10155 - DNA, 609 bp, Homo sapiens
atgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataa

SEQ ID NO: 10156 - DNA, 1693 bp, Homo sapiens
atgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgca

SEQ ID NO: 10157 - DNA, 654 bp, Homo sapiens
atgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcgggtaagggcatgggttccaccctggcggggggaacaggcgggcggccaggcgtcccgcgccacgggggaacttccaccgctgtaccccactacagccaagccaggacgacccccatattttgagcctcattggagctgggggtggagaaagccgggcagtggtctcctggcggcctggccactctgaaagtctccctagggaagagtgggcctgaggcttgtcactggtcggaccttccgcacggtaaagctaagctagggcctccataagacctccataagatctcttcctttcatcccttccggctcagcctgcatactgaagggtcctagcctccctttcccccccagttattccaag

SEQ ID NO: 10158 - DNA, 1665 bp, Homo sapiens
atgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgca

SEQ ID NO: 10159 - DNA, 1531 bp, Homo sapiens
atgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgca

SEQ ID NO: 10160 - DNA, 1505 bp, Homo sapiens
  misc_feature (17)..(17): n is a, c, g, or t
gaacttatgtgctagtncgaggctgggtgttctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgca

SEQ ID NO: 10161 - DNA, 1102 bp, Homo sapiens
atgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctcgacggccgccgacttagtagtagt

SEQ ID NO: 10162 - DNA, 889 bp, Homo sapiens
atgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgca

SEQ ID NO: 10163 - DNA, 791 bp, Homo sapiens
atgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcgggcttctgctatttcagtctttgacactgggccagcagcatcttctggagtgagaccaacatgcccaggccaccaccctgcccactctagaagtcctgggtgaaggcaaagtcctgatattagaatggctgcccttgctgaacaaatcaaggatgagaactggccttggtggctgcctggatgctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataa

SEQ ID NO: 10164 - DNA, 938 bp, Homo sapiens
atgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaaaaaaaaaaaaaaaaaaaaaaaaaaaaaaaaaaaaaaaaaaaaaaaaaaccgggggggtttggggggggggagcacaacggcgtaatcatagaagagcgcatgtgctaacctgcgtttctctgcaccccagttttttgtaacagggggagtaactgtcggggggcccccccataaggaaagagcgcaaataagtgcagaaacccgggttcccctttatcgtctagtccgacctacaacacaagaagtaggcacaacaaccagggcggacgacgtcagacgacctagctagtagtcgagaggtcaaggatagcagtcagttcatatcacccagtcacacacacagagctcagcatagt

SEQ ID NO: 10165 - DNA, 581 bp, Homo sapiens
atgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataa

SEQ ID NO: 10166 - DNA, 144 bp, Homo sapiens
aagactccaatactttttccagaagcctaccccactggtaatcagtgatctaacatacacttcttactgtccactccagcctaaggaagattggaaggatgctcagctttacaataagcatcctaaagtctaggaatttcaacc

SEQ ID NO: 10167 - DNA, 132 bp, Homo sapiens
gggatgttgataatgggggaggctatacatgcatgaggacaaatgatatacaaaaactctctatatcttcctctcaattttgctgtgaacataaatctgccctacagaaaaatagtctttaaaaatttttaa

SEQ ID NO: 10168 - DNA, 691 bp, Homo sapiens
attctcatgtaagagaataatagaaatatctcattgagatcaatgcacattgctacatgagaatattacagcaggaagaattaagtttagtttgcttcaccatgttaatacatgatcacaaaatgtgcatgagtgttattgacttatcttgtacagtactaggattcctgtaaccactcttttttttcttcgctgtattgaaactggttcagtgttaaccaggcaagcatagttattcacaggttatttactttatgtttactaattctgcttagttattgttgaatatgttctgttccagattatttttattgttttgatgtttaaaacattttgcatactgtttatcataaaacttcatgaagtaaataattttgcatataattgcaataagcactgacttttgaactgaaaagaaggaaagtgtttttttgtgcagtgcttctgaggttcatataatagtcttgtactataatgtgctttactacacgataaatgacaaaaacaagccctgtttcatgtttcatttagtgcaaaaagtcagatttccccagtgttttgttgtctgttgtacctgctgaaactacagtagttgaatattgcggtagcatttcagttctctttttttattaaagtgctcaaaaattgttttttaaatgttttcaaaaacaattaaaaacattttatatta

SEQ ID NO: 10169 - DNA, 5492 bp, Homo sapiens
gctcggtacccccgtgatagttctggcagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaagagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacaaaaccaagcttgaatggatgaataatgggtatagtggggttggtaattcatcagtttctggccatggtattctcccaagctatcaggaactagtggaagaccgtttcaggaaacctcatgcttttgctgtgcctggacagtcttatcagtctcaatccagacatcatgacactcattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctggtaggtcagggagcatctgatctcactaatactgcatctgatttctctagcgatatcaggttgtcttctgagctctcaggcagcatcaatgatttgaacactttagacccaaatctactgtttgatccaggtcgtcagcagggacaagatgatgaagctacactggaagaattaaagaatgacccattatttcaacaaatttgcagtgaatccatgaattctatgacttcatcaggttttgaatggatagaaagcaaggaccatcctactgttgaaatgttgggttaaattgtgttttataacatgtagcacactgtatctaaagacatatgtattgtatttgtcttaatggaagtgcctcccgcagcagaaatactattaattgtgacattttaaaagcgtttgctgcagaagtggtttcttcagtaggaaatggttagacttgcctcagttcttaacaagtgtctaaagacagtaggctgtagaagaacaagtattaggttttaaattttataatgtgccccatttattcacattgattgactatccagctgttacaagagcagtcgatctttattttgtgtaagttagtttcatttcatcagatgatctgcacagaactcagaataaaccatcaattttaggtataggctgttttgttgttggcattatcttttagatataaaatcatagctagggtgaactgtagacaagaaagtcttccttgaaacagggataatattcaggttattataaatatttaggcttgaagcatagagctactgtagggtgaaaaatctctgtaggactttctggggcttcagtaccatttacacccacgatgaagggcttaaatagaaaataatggaaaattaaatattactttaaggaaagcaaagctgcactaaaatttttaagggaaaaaaaacaagtagccatttatatttgtgaccttgcattaatatttaaatgttgattttaatatggagctagcacacatagatgcgcaggcacgcacacacaaaacaagcaaatgtaactccaggcatttgtaatttaatataataaatacaagcatgttagaaaaatgctttatgtcttattatttgttaagttaggggaatgagaaggaaaacaaaagcattctcttagtttcatcacaatggctgcatgtacatattgagattctaattgagatttactttgaaatttttcattaaaatattccacaataatcagtttttttcctcttcaattgagtgactgactccctcactcctcctgaatatagtaatgtagtttgatcataggatccctttgaaaaacaggaaggaggataacataaaaaacaacaaaaaacatttcaccacctaaggtctgaagccacaaatctttatatctctgatgaaacaaaggggatatcaatagtacttgaagaagaagagcattttattacttgcttaatttatttattgtgataaccacaattgcaaaagaagaactcaggatttgttttaaaatgtttctctctatggctcccattttgttttgtgaataattatttatgagttgcatgttgacacaaacctactcactggttgaaagctccatttaagtgagtttcaagatcactttcaaagagatttttaaattgccattgtttttaaagctaacataaaaccatttgctatgctaccttgaacctagctaagctttcctttaccttagtaagccaatcagaagactacaatcaatgaatatttagcaaatgtgctgaagggtttaataaggttttgttgttcaataaatttgcaaggtagggtattaacatattttgataaataaatggtgctagagttggcgcagaggtttatatattgatatgtcttagttattggcatttgtgtgtgtttgctgttatcttgatttcatgatttgttaggtatttttttcttgatgctagttatttcttcactgtacattgagacacagcactactgcacaccaaagtatgcaatacccaaaggaaactgtgtgatttctcctgacaaatgatgggagcctttctttatgagatactctgaaaaggagattttgaggccattctaatcccttgtttacattattagcttcctactaatataaaaataatggaaatcttttttgataaaaatattaagactggaggatttttaaccccttgtacagtattgcagcaaactctttaaatttggttgaattcgtccagcaaactttctggggttcatatattgcactaaatttgttgaacctgtggtaggcacatctcttaggataaatgcaaccaatacagtccacagattaaactttttaaatgtgtttcattatgaaaagacaaaatgtcatcaaagtgacagataaaattgtcttatgtagcaatgtgcattgatctcaatgagatatttctattattctcttacatgagaatattacagcaggaagaattaagtttagtttgcttcaccatgttaatacatgatcacaaaatgtgcatgagtgttattgacttatcttgtacagtactaggattcctgtaaccactcttttttttcttcgctgtattgaaactggttcagtgttaaccaggcaagcatagttattcacaggttatttactttatgtttactaattctgcttagttattgttgaatatgttctgttccagattatttttattgttttgatgtttaaaacattttgcatactgtttatcataaaacttcatgaagtaaataattttgcatataattgcaataagcactgacttttgaactgaaaagaaggaaagtgtttttttgtgcagtgcttctgaggttcatataatagtcttgtactataatgtgctttactacacgataaatgacaaaaacaagccctgtttcatgtttcatttagtgcaaaaagtcagatttccccagtgttttgttgtctgttgtacctgctgaaactacagtagttgaatattgcggtagcatttcagttctctttttttattaaagtgctcaaaaattgttttttaaatgttttcaaaaacaattaaaaacattttatatta

SEQ ID NO: 10170 - DNA, 5438 bp, Homo sapiens
gctcggtacccccgtgatagttctggcagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaagagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacatttctggccatggtattctcccaagctatcaggaactagtggaagaccgtttcaggaaacctcatgcttttgctgtgcctggacagtcttatcagtctcaatccagacatcatgacactcattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctggtaggtcagggagcatctgatctcactaatactgcatctgatttctctagcgatatcaggttgtcttctgagctctcaggcagcatcaatgatttgaacactttagacccaaatctactgtttgatccaggtcgtcagcagggacaagatgatgaagctacactggaagaattaaagaatgacccattatttcaacaaatttgcagtgaatccatgaattctatgacttcatcaggttttgaatggatagaaagcaaggaccatcctactgttgaaatgttgggttaaattgtgttttataacatgtagcacactgtatctaaagacatatgtattgtatttgtcttaatggaagtgcctcccgcagcagaaatactattaattgtgacattttaaaagcgtttgctgcagaagtggtttcttcagtaggaaatggttagacttgcctcagttcttaacaagtgtctaaagacagtaggctgtagaagaacaagtattaggttttaaattttataatgtgccccatttattcacattgattgactatccagctgttacaagagcagtcgatctttattttgtgtaagttagtttcatttcatcagatgatctgcacagaactcagaataaaccatcaattttaggtataggctgttttgttgttggcattatcttttagatataaaatcatagctagggtgaactgtagacaagaaagtcttccttgaaacagggataatattcaggttattataaatatttaggcttgaagcatagagctactgtagggtgaaaaatctctgtaggactttctggggcttcagtaccatttacacccacgatgaagggcttaaatagaaaataatggaaaattaaatattactttaaggaaagcaaagctgcactaaaatttttaagggaaaaaaaacaagtagccatttatatttgtgaccttgcattaatatttaaatgttgattttaatatggagctagcacacatagatgcgcaggcacgcacacacaaaacaagcaaatgtaactccaggcatttgtaatttaatataataaatacaagcatgttagaaaaatgctttatgtcttattatttgttaagttaggggaatgagaaggaaaacaaaagcattctcttagtttcatcacaatggctgcatgtacatattgagattctaattgagatttactttgaaatttttcattaaaatattccacaataatcagtttttttcctcttcaattgagtgactgactccctcactcctcctgaatatagtaatgtagtttgatcataggatccctttgaaaaacaggaaggaggataacataaaaaacaacaaaaaacatttcaccacctaaggtctgaagccacaaatctttatatctctgatgaaacaaaggggatatcaatagtacttgaagaagaagagcattttattacttgcttaatttatttattgtgataaccacaattgcaaaagaagaactcaggatttgttttaaaatgtttctctctatggctcccattttgttttgtgaataattatttatgagttgcatgttgacacaaacctactcactggttgaaagctccatttaagtgagtttcaagatcactttcaaagagatttttaaattgccattgtttttaaagctaacataaaaccatttgctatgctaccttgaacctagctaagctttcctttaccttagtaagccaatcagaagactacaatcaatgaatatttagcaaatgtgctgaagggtttaataaggttttgttgttcaataaatttgcaaggtagggtattaacatattttgataaataaatggtgctagagttggcgcagaggtttatatattgatatgtcttagttattggcatttgtgtgtgtttgctgttatcttgatttcatgatttgttaggtatttttttcttgatgctagttatttcttcactgtacattgagacacagcactactgcacaccaaagtatgcaatacccaaaggaaactgtgtgatttctcctgacaaatgatgggagcctttctttatgagatactctgaaaaggagattttgaggccattctaatcccttgtttacattattagcttcctactaatataaaaataatggaaatcttttttgataaaaatattaagactggaggatttttaaccccttgtacagtattgcagcaaactctttaaatttggttgaattcgtccagcaaactttctggggttcatatattgcactaaatttgttgaacctgtggtaggcacatctcttaggataaatgcaaccaatacagtccacagattaaactttttaaatgtgtttcattatgaaaagacaaaatgtcatcaaagtgacagataaaattgtcttatgtagcaatgtgcattgatctcaatgagatatttctattattctcttacatgagaatattacagcaggaagaattaagtttagtttgcttcaccatgttaatacatgatcacaaaatgtgcatgagtgttattgacttatcttgtacagtactaggattcctgtaaccactcttttttttcttcgctgtattgaaactggttcagtgttaaccaggcaagcatagttattcacaggttatttactttatgtttactaattctgcttagttattgttgaatatgttctgttccagattatttttattgttttgatgtttaaaacattttgcatactgtttatcataaaacttcatgaagtaaataattttgcatataattgcaataagcactgacttttgaactgaaaagaaggaaagtgtttttttgtgcagtgcttctgaggttcatataatagtcttgtactataatgtgctttactacacgataaatgacaaaaacaagccctgtttcatgtttcatttagtgcaaaaagtcagatttccccagtgttttgttgtctgttgtacctgctgaaactacagtagttgaatattgcggtagcatttcagttctctttttttattaaagtgctcaaaaattgttttttaaatgttttcaaaaacaattaaaaacattttatatta

SEQ ID NO: 10171 - DNA, 3062 bp, Homo sapiens
gctcggtacccccgtgatagttctggcagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaagagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacatttctggccatggtattctcccaagctatcaggaactagtggaagaccgtttcaggaaacctcatgcttttgctgtgcctggacagtcttatcagtctcaatccagacatcatgacactcattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctgaaataccctgatgtattaggagaatgaagatttaaaaacaaaattttgttttccacacagcttttcaagcatatttcatacaggtatactctagtcatatttatgtttaaatcacttaaaatgtcatcaaaataaaaatgggactttttttttaacagatgataaagtgcctaaaatatgtcagtctctgtacaaggtgctagagaagacacctgccattttgaaattttgcaatataatgaaaaagacacagtgaatgtctttgcaggatgcaatgaggtcactatagcagaggcggatacttaccagtagtatgcattctccccttcttctttactgtaaaagtccttgatttttagctgagcacacagccatctgaccaaaaggctgcatctgccaacttcccttgcagttaagtggagacacttaccaagtactcaaagagatgtaaccaaaaggtttgggtgctacttctttgcagtgttcttgtccttcctctctgctggctggaatgcaaatgtgatggctagaactcaagcagccctcctggacttcatgttaaagacacatgctgaggatgattgagcaacaagatacaaggagcccagggcatgatgactttggaagggaagatgcccaactagtcctgactgcttacctctggatgtgttttacatgagagaaataaatgtctttctggtttaactcacaaatattt

SEQ ID NO: 10172 - DNA, 2581 bp, Homo sapiens
gctcggtacccccgtgatagttctggcagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaagagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacatttctggccatggtattctcccaagctatcaggaactagtggaagaccgtttcaggaaacctcatgcttttgctgtgcctggacagtcttatcagtctcaatccagacatcatgacactcattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctgtgttcttgtccttcctctctgctggctggaatgcaaatgtgatggctagaactcaagcagccctcctggacttcatgttaaagacacatgctgaggatgattgagcaacaagatacaaggagcccagggcatgatgactttggaagggaagatgcccaactagtcctgactgcttacctctggatgtgttttacatgagagaaataaatgtctttctggtttaactcacaaatattt

SEQ ID NO: 10173 - DNA, 1404 bp, Homo sapiens
cattgttataaatgaatttttaaataattaaagttataaatttatggatgggatcacttattaatattgcatcatctgaaattttaaaaatatgtatgccagtcttgttgctataatctgcttagaaaaaagaacaaaacaaaaagactacatttttcaagatttgatttttaagaagtacttaattcttggagaggagaagagagtcatataaataaaatatatcatgagagtgatattactgtggtatatagagtatttctttgcattagacccagtgttagtttgcatatattctcatgtcctcattgtaacaatttttagcgagtattatttttcaggtgagaaaattttacttcagagattaactggtgggaggtaacataataacaggaagagccagggattatcttaatttcaaatcccacttccataccattatgctatacttaaggatatgtgttcacagtgtacctactgccagttgtatgatctggttgcttctttgaaattttcattctggttttaaatttagaattgagtttgatttttgtggagttctttatttaacctcccatccttatatgtcaacaattctttttcatttttattgcttttagatttacctgtagtttgtaattttcctccaaattacttgaatccttttccctcccttctctccatagaaataccctgatgtattaggagaatgaagatttaaaaacaaaattttgttttccacacagcttttcaagcatatttcatacaggtatactctagtcatatttatgtttaaatcacttaaaatgtcatcaaaataaaaatgggactttttttttaacagatgataaagtgcctaaaatatgtcagtctctgtacaaggtgctagagaagacacctgccattttgaaattttgcaatataatgaaaaagacacagtgaatgtctttgcaggatgcaatgaggtcactatagcagaggcggatacttaccagtagtatgcattctccccttcttctttactgtaaaagtccttgatttttagctgagcacacagccatctgaccaaaaggctgcatctgccaacttcccttgcagttaagtggagacacttaccaagtactcaaagagatgtaaccaaaaggtttgggtgctacttctttgcagtgttcttgtccttcctctctgctggctggaatgcaaatgtgatggctagaactcaagcagccctcctggacttcatgttaaagacacatgctgaggatgattgagcaacaagatacaaggagcccagggcatgatgactttggaagggaagatgcccaactagtcctgactgcttacctctggatgtgttttacatgagagaaataaatgtctttctggtttaactcacaaatattt

SEQ ID NO: 10174 - DNA, 2664 bp, Homo sapiens
gctcggtacccccgtgatagttctggcagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaagagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacatttctggccatggtattctcccaagctatcaggaactagtggaagaccgtttcaggaaacctcatgcttttgctgtgcctggacagtcttatcagtctcaatccagacatcatgacactcattttggtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagaagttcatgttttcacaaatgttcacacagacgcatgtgccaacaacatagctcaaagaagccaatcagttccattgacagtcatgatgcagacagccttcccaaacgctcttcagaagcaagcaaacagtaaaaaaataaccaatgttttgttgagtaaacttgattccgacaatgatgatgcagtgagaggtttgggaatgaacaacctgccctctaattatacagcccggatgaatctcactcagattttggaaccttccactgtttttcctagtgccaacccacaaaatatgatcgattccagcacttctgtttatgagttccaaacaccatcttacctcaccaaaagtaatagcaccggtcagatcaatttttctcctggagataatcaagcacaatcagaaattggagagcaacaattagatttcaatagcactgttaaagacctgttgagtggagacagcttgcaaaccaaccagcagctgaaataccctgatgtattaggagaatgaagatttaaaaacaaaattttgttttccacacagcttttcaagcatatttcatacagtgttcttgtccttcctctctgctggctggaatgcaaatgtgatggctagaactcaagcagccctcctggacttcatgttaaagacacatgctgaggatgattgagcaacaagatacaaggagcccagggcatgatgactttggaagggaagatgcccaactagtcctgactgcttacctctggatgtgttttacatgagagaaataaatgtctttctggtttaactcacaaatattt

SEQ ID NO: 10175 - DNA, 1714 bp, Homo sapiens
gctcggtacccccgtgatagttctggcagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaactttcaccagcagcagctcaccacctaatggtgactcaatcaataaagaccctaaattatgcactaaaagcccaagaaaacgactgtcttctacattgcaagagacccaggtgcctcctgtaaagaaaccaattgtggaacagctttcagcagctaccatagaagggcagaaacaaggcagtgttaagaaggaccaaaaggttccacattcagggaaaacagaaggttcaacagcaggtgctcagattcctagcaaggtatcagtaaatgtcagttcacacataggagcaaatcaacccttgaattcctctgcccttgttatcagtgattcagctttggaacagcaaacaaccccatcatcatctccagatataaaagtaaaacttgaaggaagtgtctttctcttggacagtgattcaaagtcagttggcagctttaatccaaatggatggcaacaaatcactaaagattctgagtttatatctgccagttgtgaacaacagcaagatatcagtgttatgacaattcctgagcactctgatatcaatgacttagagaaatctgtttgggaattagaaggaatgccacaggacacatatagccagcagctacatagccagatacaggaatcttctttaaatcaaatacaagcacattcttcagatcagttacctctgcaatctgaactgaaggagtttgagccttctgtttcccagacaaatgaaagctactttccttttgatgatgaacttacacaagatagtattgtggaagagctggtgcttatggagcagcaaatgtcaatgaacaattctcattcttacggcaactgtttgggaatgacccttcagagtcagtcagtaactccaggagctccaatgtcatctcacacttccagcacccacttctatcatccaatccacagcaatggcactccaatccacacacccacacccacacccacacccactcctactccaaccccaaccccaaccccgacatctgaaatgattgctggatctcagagtctgtcacgggagagcccttgctccaggctagcccagactacacctgtggatagtgctttaggaagtagccgacatacacccattggtactccacattctaactgcagcagtagtgtcccccccagccctgttgaatgcaggaatccgtttgcattcactccaataagctccagtatggcatatcatgacgccagcattgtctcaagtagtcctgtgaaaccgatgcaaagacccatggccacacaccctgacaaaaccaagcttgaatggatgaataatgggtatagtggggttggtaattcatcagtttctggccatggtattctcccgacacgagccccagatgcagtctacacagaactccagcccacctctcctgaccccaacctggcctgctgatgtaacaccacaactccagacccagaccctagcaactggaaggtacggatggcctgtagtgacacttgcatccagacgggtatcctctgg

SEQ ID NO: 10176 - DNA, 673 bp, Homo sapiens
caaagactccccagaacgttccagccagtcctggtggggatcgttctgcccggcaccgttaccctcagatcttacccaaaccagcgaacaccagtgcactcaccattcgctctccaactactgtcctctttactagtagtcccatcaaaactgctgttgtacccgcttcacacatgagttctctaaatgtggtgaaaatgacaacaatatccctcacacccagcaacagtaacacccctcttaaacattctgcctcagtcagcagtgctacaggaacaacagaagaatcaaggagtgttccacagatcaagaatggttctgtcgtgtcgcttcagtctcctgggtccaggagcagcagtgcggggggaacatctgctgtggaagtcaaagtggaacccgaaacatcatcagatgagcatcctgtacagtgccaagagaactctgatgaggctaaagctccccagacacctagtgcccttttggggcagaaaagtaatacagacggagcactgcagaaaccttcaaatgaaggtgtcattgaaataaaagcaactaaggtctgtgaccagaggaccaaatgtaaaagtcgctgtaatgaaatgctgccaggcacgtcaacaggcaataatcaaagcactatcactctatcagttgcttctcagaacttaacttt

SEQ ID NO: 10177 - DNA, 960 bp, Homo sapiens
gaaggatggggacaacttggaagccagaagaagaacctggaagccacagtgggtgcgactcaattcacacccggatccagagtttcaaagagaggcaaagggggaaagagactgaggttgtaaacgttataagcagtttttatatataacttatttaatacaaatgtgacttaattaagcgtaaccttttctctggagttgtggtgaaactaatcacgtctgtgagagatcagaaagaaagagacttagggaagtggaagagaaagggaattttggaatttatttctttaaaaataatgcaatggaaatatatcaaaacatgtaaacgcccaccttaaaccaaatgttatttggtcatgaggcaccttgctggagtctcagattccaaaagtctcttcttcagactgggtagggaatatgatattttagggacaaagctgaggactggttttaaataggctttaaaataaaagatcaatattatcataatgctatcattctgctaaacggccccaaaacagtagaatttctgctcatgtcctagcaggttcagaagactgcagccaagttcagatgtaaaaacaagaagtagcacttttccaaaggaaaacaacaaaacaaatgggaaaaagataatggaccgcatttcacctattttaatactattttaacaattttttcatctaccaatatatccccaataaataaatataaaagggggggagggtcaatctggggaatcttagttttttatgttttaagaaaacaaaaaaaactgcattatttttgtaaagtatttattgagtcacggattattgtgcatcaagcaattgttaatatgacctggtcctatggggtagaacttaggaaaaataaagttggttcttattcaatattttactttgcaaaattctagtaaaagagagtatataataaaatcataataaaaggtgttacctg

SEQ ID NO: 10178 - DNA, 393 bp, Homo sapiens
atcttctgactgaagttgaagataaaacctgataccagtttggagtagaaagagacacagtattgtaatcataaatgacatttgaccttaaaacagtaacacagcaaatttctaattaaagtggagcatgtcctgtcttgactgaggcaccaagacgatttgttgcagattgttgctggcagtgtgcagtccccaagaccaaatcaccaagaggcacagtggtaagagtggtcagcaaggagcggagcgccttcctcccaccagcaggtgactcaccacatcgtgtcctccttggcgtaagaggcgccctaaaggtttctccgttccagttatcctaactggaatactgttcctgaaaaaagcgtatatttaaggccctgctagctataagca

SEQ ID NO: 10179 - DNA, 292 bp, Homo sapiens
cactgaagcctcaaactgctgggctcaagtggtcctcctgcgtaagcctcctgaatagctaggactacaggtactcgtcaccatggctggctaattgtttgtacttcgttgtagagacagggtgtcactatgttgaccaggctggtctcaaactcctgggctcaagtgatcttcccacctcggcctcccaaagtgctgggattacaaacagcccctttgcccagccttccttcctgtctttcaacaatgttttgtagttttcagaatataagttttgttcttgttaaattta

SEQ ID NO: 10180 - DNA, 401 bp, Homo sapiens
tttttttttaactattatccccaaggtgggaaacagttttgttagctggtactactggaagcaccctggggcaattttgtattcaggatctttctgcttgaactccccatttgagatttctgaatggcttctctaagaaacaaccatgcacccaggagcccctcactctgtagcaagaattgattagggttgggaagccattgagaaaacacgcctgggcctgaataacatcaaaatgcctaagttcatctagcacagacatcttaatgtgacacatttcaagaatatttattccttctttagcagaaaaacaggattcaaaagtctctgtttcatggccatgactgtgccccatcatgataaacaattgattattcagtacacaatggccaggattaaat

SEQ ID NO: 10181 - DNA, 611 bp, Homo sapiens
agtagagacagggtttcaccatgttggccaggctggtctcgaactcctgacctcgtgatctgcccgcctcagcctcccaaagtgctgggattacatgcgtgaaccaccgcacccggctgcctttgcattatttttaaagtcacttctcagctttatcctcaactgattaataatactgttcatttttttcttttacgctttatgaatatctatcccttttccatacttctagcacttgaacttgtcttcactgcctctctcagttttcactaccaacaacatcctaggttggccttcttcaccctaaattttctgtcaatccatctgtatttcactgctaattgattttttctttaaagccattttcatcaagttagtaatctgcttaaagacctttaagtctaaattctggcctcaattccaagactctccataatctggttttacacatggtagttcttaagttagataaacctttcttcactagcttctaaacctaacatcttcattccctttatatctgtttattccctttatatctgttgtttctccattcccctttcaccatgcttctattccctaggcccgttcagattgagtattgtataaag

SEQ ID NO: 10182 - DNA, 417 bp, Homo sapiens
acttatattcctggtgaattgatatgttccttcatcttcagtgatgtgtcttgccacaaacactgtatttgtatgtttacaataatttccttttatttaggattcgcatcgtaaacttttcccttccttgtactttcaatctattttcatccttatgtttaaggtgtatctgttgtgtctactgttgtcgttttttaatccagtctgacaagttttgtcatttaataagagtatttaattcatttacatttaataaagctacttatgtaactggacttaaatctactaccttccaagttgatttatgtttctccataaacataaacacagaacacagaacatgttctgtgttcctttttctatggtttcttattgtatagattatttaaaatagtttacattttcccctattgcttg

SEQ ID NO: 10183 - DNA, 1229 bp, Homo sapiens
gctgaaggacagtgaaactggcagcagaaagggggaaagaaaaaaacaagaattatgaataatctacaaatataattatctctaaataatggagagttgaccaaaataccagagtggtaatacattctgagtccagaaatgtcaattaagtgttccccaacagcttctcttttctgcagcaatccctcgaaaacaaatctatacttgaaagggtgggggcaagatgggggagaatcaccccacagaactgttaattaagggaaccggagcaggttttacccagtggctttctaccattaaattgagttctttaaaaatgtgacatgaagtgcagttaatgataggaattcggtgattgaaccataatgatctctccctgtccttaaacacaaatgtagggaaggcttcaggttattgggaaaatgtatacctgaagcaaaatgccatcagcactcaaattggcataaagccttgaggatgatggcaagaaatagagtgttagaaattactgcatgttcaatgaaagctttattcaggaaacacacgtttcctacccttacagactgctaagaatttaaatgctggaacctcagaagtatgcctgtgtttcagaattttgcattttaaactaaaatcacctactatggtgggggaaacatgtcttagacttgacataggttggctttgttatattaagttttatataagcaatctagaaactatcccctaaaatgaaattaaaaggtaacagggtaaaactgaaacatgggggttgagaatgactggaagtaaatgttaaaaagcaaatctagatgtttgaacacaaaatagatcataaagcccaagttacctggatttattttctttttttattaatgcagcccaggcttcccaaataaatttcaactttctgctctatttggagttgtatagatccaggtaatttctgaacagtttcaccctaagtggtaaaaatacgttcatttgcacaaatgttttcaatttaaaaagcaagcatttgtttaaatttggaggacgaaatatgtttatttctccatgtgtcatttccaaattatatggattctgaaaaatacaacatcatttttctatccaaccttaagttttatgattttttttacaatatggttactgtgtctatgtcaatagacatttatgaaatgacctattaataggaattttcactgaaaatatatggctgtcatatatct

SEQ ID NO: 10184 - DNA, 1109 bp, Homo sapiens
gctgaaggacagtgaaactggcagcagaaagggggaaagaaaaaaacaagaattatgaataatctacaaatataattatctctaaataatggagagttgaccaaaataccagagtggtaatacattctgagtccagaaatgtcaattaagtgttccccaacagcttctcttttctgcagcaatccctcgaaaacaaatctatacttgaaagggtgggggcaagatgggggagaatcaccccacagaactgttaattaagggaaccggagcaggttttacccagtggctttctaccattaaattgagttctttaaaaatgtgacatgaagtgcagttaatgataggaattcggtgattgaaccataatgatctctccctgtccttaaacacaaatgtagggaaggcttcaggttattgggaaaatgtatacctgaagcaaaatgccatcagcactcaaattggcataaagccttgaggatgatggcaagaaatagagtgttagaaattactgcatgttcaatgaaagctttattcaggaaacacacgtttcctacccttacagactgctaagaatttaaatgctggaacctcagaagtatgcctgtgtttcagaattttgcattttaaactaaaatcacctactatggtgggggaaacatgtcttagacttgacataggttggctttgttatattaagttttatataagcaatctagaaactatcccctaaaatgaaattaaaaggtaacagggtaaaactgaaacatgggggttgagaatgactggaagtaaatgttaaaaagcaaatctagatgtttgaacacaaaatagatcataaagcccaagttacctggatttattttctttttttattaatgcagcccaggcttcccaaataaatttcaactttctgctctatttggagttgtatagatccaggtaatttctgaacagtttcaccctaagtggtaaaaatacgttcatttgcacaaatgttttcaatttaaaaagcaagcatttgtttaaatttggaggacgaaatatgtttatttcgcagggcccttacctttacaacttcctatcatctgaaattatttcaaaatataaag

SEQ ID NO: 10185 - DNA, 285 bp, Homo sapiens
aattcagaaaagtatcagactaaattttaaagtctactttaaactgagtctttgctttatagttgcataaataaattcattttgatggttttctcagaacagatgaactggctgggtgcggtggttcatgcctgtaatcttagcactttgggaggccaaggccgatggctcacttcaagtcaggagtttgagaccagccaaaaaattagccgggtgtggtggtgcacgtttgtaataccagctactcaggaggctgaggcaggagaatcgcttgaacctgggagg

SEQ ID NO: 10186 - DNA, 861 bp, Homo sapiens
aaaaaaaacagacaaggtgtcaggagattaggattactggtttagctacagcctcttccttaatctatggtatctcagtctcagtgtactcacttacatgtaatatctaatggtatttgtacagaactaaaatacataaattcataaaagttattaatgtgtaaagcactgataaagtttttttttgttgttgttgtttttttttttgagatggagttccactctttttgcccaggctggaatggtgtgatctcccgtcactacaacctccacctcccaggttcgagcgattctccagcctcagcctcccgagtagctgagattacaggcgcccgccactatgcctggctaatttttgtatttttagtagagatggggtttcaccatgttggccaggctgctctcaaactccagacctcaggtgatctgcccgcctcggcctcccgaagtgctgggattacaggcttgagccaccacgcctggccaagatttttcaaatgcttctcacaagcactttttaatttacaaagcattactttagactttgtatacattcatgtgagtaaggggacaagaatttaaggcccagtagtattgcttgttcagaaaggtactgctcagtattggaccagcttgctgtgtagctggacacctgaaagacattttctacttctacaggcagagattgagcagcatcttgatgctccctagtgcgttaacataagcagaatttacacccttttcagccttggccgagtgcctctgcttagccaacattcctactaagctcctttgtctcgattgtgtcttgctttggttgctaaaaaaaaaatcttaactaaaataacagatgttttgggg

SEQ ID NO: 10187 - DNA, 214 bp, Homo sapiens
gtagtacatcttgtgctcttattggccaagtttttcatctgcattccatggaaaaaaagtttggctatcatttgtaagagtatgatcagtggtgtgttgctatgagcccgtgaaatagaaaaacaaaattaggaaagacctatgtagctagaaaatgtggctttttaaaattgtcatcagaaagctattaatgacttttaaggaagcaagaaag

SEQ ID NO: 10188 - DNA, 276 bp, Homo sapiens
gggactacaggcgcccgccaccacgcccagctaattttttgtatttttggtagagacggggtttcactctgttagccaggatggtctcgatctcctgacctcgtgatccgcccacctcagcctcccaaagtgctgggattacaggcgtgagccaccacgcccaggcaattcaggggttttaagtgaaggacaactgaaatcacctagcccaccccttgcgtgtttaagcatcaaggagcattcattggtgatgatttgaatgtcctgggacagtgg

SEQ ID NO: 10189 - DNA, 1021 bp, Homo sapiens
atctggaataaagtccaaaattactgggcataaaagaaccaagaaaatttcaactctgaaaaagacaaccgatgtcagtattaagatgacacagatgttggaattatttgacaggctttaaagtggctattatgaaaatgctccagcaagtgagggcaaacagtcttgaaatgaatggaatgatagacaggtcagcaaataaacagaagaccttaagaagaaccaaatggagattttagcactgaaaaatactgtaagaaaatttaaatctcactgcataaatcagtaatagaatggatttgactaaggagtcagtgaacttgaagataggtaatacaaattatcctatctgaacaacagagagaaaaaaagattttaaaataatgtctgagggacctgtggggcaattataaaaggtctaacattggggccactggaagagaaggagaagaggaggagaaagtgcagtacagaagtctttaaagaaagtaatggctgaaaacttctcagatttggcaacaggcataaacctacagattcaaaaagctcagcagaccctaaataggataaacctaaagaattccatgcccaaacctataatcaaactgctgaaaagattaaaaaagaagtctcgaaagcagttggaaaaaaacaactcattgcttaaaaagaaacaagaatttgaatggttacgaatttctcatcagaaatcttggaggccagaaagaagaacagcattcttaaagtatggagagaaaaagaattgtcaacccagaattctatatccagtgaatatttcaccttcatttctaaaggatattaagatattattaagaatatcttaacaaagaaactaagagaattcatagtcaatagatcttctcaaaaggagttttaaaaggaagttcctcagacagaatggagatgataccagatggaaacttcaaacatcaggtataaaagaagagtggtagaaatggtaaatatgtgggtaaatataatggacagttctctaaaatag

SEQ ID NO: 10190 - DNA, 299 bp, Homo sapiens
gctgggttgccagattttggaaagcggaggcgatgctgaatttatctgtgtatccttagtgtccggcaccgtgtttggatctcaaggggagctcagtgaatttgatgaatgaacatgtaatttaacaaatgctcgcttcctttcggaaaggcttcatctggcttccccagataatttcatgtcgcctctgctgcagtccacttcctatcacgaatctctacctatttaaactgcactctctctactcttcatttactattttgaggtttttccaaataaaaatcatacgtcagcatgca

SEQ ID NO: 10191 - DNA, 126 bp, Homo sapiens
gaagaatgttacagaaagcggtggaagggaacaacgaaaataagaaatgtgctagaagcttgtacaccagctgggttctccttactgccagggctttagctacaaaaaaaaaaaaaaaaaagaaag

SEQ ID NO: 10192 - DNA, 372 bp, Homo sapiens
tttcaagcacccaaaaatggaagactgcactgaaggaaatttgttcgaaagaacttgagagattagggggtgaaattagatagagaaaaaaattctaaacacgttgagatatgtcgtcagtaaaatgcgctttggcataacaaagttgtgaattgaaacagttacagaaatattgtggctggggaaatcccaagtgtttctacagttgaacatccctgattagaaaatccaaaatcagaaatgttccaaaatccaaaactttttaagcactgacatgatatcacaaatggaaaattccacacctgacttcatgtgagaggtcacagtcaaaacgcagccaaaactttgtttcacacaaaaaatatttaaaat

SEQ ID NO: 10193 - DNA, 480 bp, Homo sapiens
acctggataagactcccagatgctcccttgtttatctgtgaccaggccagacacagaccctctaaattcccattcttggcctcataaatgattagctgggctgcttgtcccacagatcaataagaacaaaagcctgtaaccaaaccttggttcagattctctccttttccaagcccttgagctttggcccacccacagcttgtgccaacccgcagccctcctgaggttccctcctgagaacaggctgtccgcagggtaagacctcctcgatcgtgacactcttgctcagcccactttcccataacagttctttctagccacgtttacgcctccctatacaagatcagccctttgcctaacctctgagacacttgcagatcatatgggaagcctgcgagtggccgcactgcaacgtttccctattgcaatggtcacccccacaacaatcctttggaataaattcgctccttatataatcca

SEQ ID NO: 10194 - DNA, 294 bp, Homo sapiens
cccttggaggattagtggccccacgcaggtgtgcaagacccacgggtcccctcaatcagaagcgggatgtgtggcagggagctttggagagctttccattttggattagtgatttccctgtcgacttttccctcgtttttgtcacagcacactcggaacatttctcatcagctgtgtacactatgtcaggcatttcaaatatgtttctggaagttgtcagtgctgttctctatgaggcctgaaggaaaaattcaatgtttgtagtaaataaagtacaaaaattatatcagtcta

SEQ ID NO: 10195 - DNA, 286 bp, Homo sapiens
tgggggacaggctattcacatagtctcaaataatcacattctaggttatttattagttataaagttaaagaggtactgtcacaggggagaaacctggcagacatcacttgaatcgagtgatcaacctgaacaggaccagcaatgggatgcagcaaccctcctgggccctcggaaaacagtgtggaaaatactatggaatagtatgcagacagaaaaaagaatgaaatcatgtcctttgcagcaacatgggcggagctggaggctattattctaagtgaaatagaat

SEQ ID NO: 10196 - DNA, 1805 bp, Homo sapiens
gagggctccactcaagtgaccacttgcagccctgagccattaccaatcgcgacccgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcgctgcaggtgtcggcgcagccggcggagcaggagctgcggcggctgcgggaggagaacgagcgcctccgcagggagctgcgcgcggggccacaggaggagcgcgcgctgctgcggcagctcaaggaggtcacggaccgacagcgggacgaactccgggcgcacaaccgcgacctgcggcagcgcggccaggagaccgaggcgttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcgggagctgctcacagaccaccgggtccccggccttctgctcgaggccatgaaggtggctgtccggaagcagcggaagaagatcaaggccaagatgttagggacaccagaggaagcagagagcagtgaggatgaggctggcccatggatcctgctctccgatgacaagggagaccatcccccacccccggagtccaaaatacagagtttctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtaccgagcctctggggccagatataagagtgcctctctgagtctcagtttccccatccatgaaatgagagctgactgcctagctcccagggctttgtgcagacggcctgagctcatgtaataaagaactgcccgtaatacacagaaaaaaaaaatc

SEQ ID NO: 10197 - DNA, 534 bp, Homo sapiens
gagggctccactcaagtgaccacttgcagccctgagccattaccaatcgcgacccgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtcgagcctctggggccagatataagagtgcctctctgagtctcagtttccccatccatgaaatgagagctgactgcctagctcccagggctttgtgcagacggcctgagctcatgtaataaagaactgcccgtaatacacagaaaaaaaaaatc

SEQ ID NO: 10198 - DNA, 1721 bp, Homo sapiens
gagggctccactcaagtgaccacttgcagccctgagccattaccaatcgcgacccgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcgctgcaggtgtcggcgcagccggcggagcaggagctgcggcggctgcgggaggagaacgagcgcctccgcagggagctgcgcgcggggccacaggaggagcgcgcgctgctgcggcagctcaaggaggtcacggaccgacagcgggacgaactccgggcgcacaaccgcgacctgcggcagcgcggccaggagaccgaggcgttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcgggagctgctcacagaccaccgggtccccggccttctgctcgaggccatgaaggtggctgtccggaagcagcggaagaagatcaaggccaagatgttagggacaccagaggaagcagagagcagctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtaccgagcctctggggccagatataagagtgcctctctgagtctcagtttccccatccatgaaatgagagctgactgcctagctcccagggctttgtgcagacggcctgagctcatgtaataaagaactgcccgtaatacacagaaaaaaaaaatc

SEQ ID NO: 10199 - DNA, 1625 bp, Homo sapiens
gagggctccactcaagtgaccacttgcagccctgagccattaccaatcgcgacccgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcgctgcaggtgtcggcgcagccggcggagcaggagctgcggcggctgcgggaggagaacgagcgcctccgcagggagctgcgcgcggggccacaggaggagcgcgcgctgctgcggcagctcaaggaggtcacggaccgacagcgggacgaactccgggcgcacaaccgcgacctgcggcagcgcggccaggagaccgaggcgttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcgggagctgctcacagaccaccgggtccccggccttctgctcgaggccatgaaggtggctgtccggaagcagcggaagaagatcaaggccaagatgttagggacaccagaggaagcagagagcagtgaggatgaggctggcccatggatcctgctctccgatgacaagggagaccatcccccacccccggagtccaaaatacagagtttctttggcctatggtatcggggtaaagctgaatcctctgaggatgagaccagcagccctgcacccagcaagctagggggagaagaggaggcccaaccacagtctccagctcctgatccgccctgttctgccctccacgaacacctttcgagcctctggggccagatataagagtgcctctctgagtctcagtttccccatccatgaaatgagagctgactgcctagctcccagggctttgtgcagacggcctgagctcatgtaataaagaactgcccgtaatacacagaaaaaaaaaatc

SEQ ID NO: 10200 - DNA, 363 bp, Homo sapiens
aagaaaggtgtttgaatttattcactgttaaagtttctagtttcagagaaacaaaataaccaacacttacctgtagggcctggccaggtggctcactcacgcctgtaatctcagcactttgggaagtggaggcgagaggattgcttgagcgtaggagtttgatatcagtctgagcagcatagtgagactttgtcactgccaaaaaataaaagaaattagctgggcgtggtggtgtgcgtctgtagtcccagaagctgaggtaggaggtttgcctgagcccagagttcaaggttgcagtgaggcacagttgcgccactgtactccagcctgggcgacagagtaagaccctgtcttaaacaaaaa

SEQ ID NO: 10201 - DNA, 696 bp, Homo sapiens
tggcgtgctgtgttaagcacaagtggatgtacatacaagagggacaggtgcacacgtccacacacacatcaggggacatgcaggtggaatgcaacactcgtgtgcacaccagctatatacgcaaatgctttctctcaggggcaggtagggcttacacacacgtgtacacacaggcacatgtgcacagatgaacacgtgtgtcagtgaaatagggcatttgccaacgcatgccagtctgtcccgtttgtcctgcacgttccctcaaacacgcagggatgtgcacacacgtagataggatgcggcacctctgaccgagttaagtcatgcctaccacctttatgggtgcaggtgagaagcgggcaggtacacaacttaaaatctcacaccccagaagtgtgcatatatgaacagacatgtacaccaactgcacacatgctcacaatcttgtaggccaggggtgggcaaactatggcccacaggctgagtcctgccctctgtttgattgtataaataaagctttattgagctgggcacagtggctcatgcctgtaatcccagcactttgggaggctgaggcgggtggatcacttgaggtcaggaattcgaggccagcctggccaacatggtgaaacccggtttctactaaaaatacaaaaattagctgggcgtggtggtgtatgcctctaatcccagcta

SEQ ID NO: 10202 - DNA, 960 bp, Homo sapiens
attggatagttccagtggagaaagattagactcctcagaagctaattgactagggaaggatcaggaagacaagacacatcaaaaaggggagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaagaagtaccaggaaacgttgaagaaaatagaagaagaactagaggctctgttccttgagagagaagtatcaaaactcgtgagcatgaaccctgtggaaaaagagcataccagccaaaataatgagggtactcctacccaaaagacagcaagattattcagtaaaaaatgggcctcctccttttagtggcaagatggctgccaacaatccagatctcgtactaccagattggcaacctttgcagaataaaagtcttttccaacagg

SEQ ID NO: 10203 - DNA, 1174 bp, Homo sapiens
aggaagcatcacaggaaaagctttgggttttcatgccttcccttcatgctcctagatctgctggactctgtgtccatctcagcacaactggagggcttctcttgtccaccaagcttcttaccacatctacaccccacttaacgggtctgagaatgctcagtcgcttcttctgcgccaccctaattatacttgcaacaacctcctcactcttacctccttcacctgtttatgtttcctcatggcagtgttaccaagcaaaagagtgtcactgcccaatgtgctggaagccaatactatgacacaagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaagaagtaccaggaaacgttgaagaaaatagaagaagaactagaggctctgttccttgagagagaagtatcaaaactcgtgagcatgaaccctgtggaaaaagagcataccagccaaaataatgagggtactcctacccaaaagacagcaagattattcagtaaaaaatgggcctcctccttttagtggcaagatggctgccaacaatccagatctcgtactaccagattggcaacctttgcagaataaaagtcttttccaacagg

SEQ ID NO: 10204 - DNA, 500 bp, Homo sapiens
gaagagaagtgctgggtagaaaagggcatggtctgtggctagagttccatccccggacctgtgcctatggatctaagtgtggacaggaatttttgttttcctgccctatggttgcattacccaagaccaacctggcctaccatgcccctatcctgtgtctataaaaacccctgagaccctagctacttccactcaataaaacctggcactcattctccaagaccctagcagatagacacacaggtgctggacataaggaagagcaccaccagtgaagaaagacatgcacacgggtatcgggacattgagaggcgcacaccgacaggcaccagcgtgctggcaggccaccaaccagcggaacaatgcggagtttggctggggcagttggaggagagctagggccaccaactggcccaactccagggaaaaatcatctcccttctggctcccccatctgctgagagctacttccacttaataaaaccttgcactccttctcc

SEQ ID NO: 10205 - DNA, 214 bp, Homo sapiens
catcctcttatcttcttcctcttcctgaccacccctaccctcattttagatcttaatctattcagttttacagatgctgagatcgctcccaatccgcccacacatctggttagattcgtatttccctggctggcttgtattttaccagcatctgtcaaccctatttacttcttaattgttctttgggcatttggaggaaaagcctgcctgggga

SEQ ID NO: 10206 - DNA, 373 bp, Homo sapiens
ctcctctttacagacgcagcaactgaagttcagaccagttgggtggccaaggtcacagctagtaattggcggaagagagattaaaatccagtttcggctgggcgcggtggctcacgcttgtaatcccagcactttgggaggctgaggcggagggaacacctgaggtcaagaatttgagaccagcttggccaacatggcgaaaccccaactctactaaaaatacaaaaatgagccgggtgtggtggcgcgtgcctgtagtccccgctactcaggaggctgaggcgtgagaatcgcttacacccaggaggcagaggttgcagtgggccgagatcgcattgctgcactccagcctgggcaacagagcgagactcca

SEQ ID NO: 10207 - DNA, 642 bp, Homo sapiens
acacacatctgtcagtaggaactagagaagaagattccttctagtaaccttctggcaactcagtttacatgtttctcacaaccctcaaatgcccagtcctgccccctaaaatgtaatgtggcttattcattggtgtctctccatgttgttcttcaggaacaggtgttgttgcaaaaataatggcataatggctcaggcaatatttgtgatgatggtaggcctcagctctacccatgtctcctgtagtcccacttagcttctgtaactagattaggaattttactccttacaatctcaagaaaatttcccttggctctcttgaatgttcgactcagaattataaattgaaaggtatagggccaggcacactggctcacacctgtaattccagtactttgggaggctgaggtgggaggatcacttgagcccaggaattcaagaccagcctggccaacatagtgagaccccatctctgcaaaaaatacaaacattagccgggcattgtggtgcacacctgtaattcccaggtactcaggaagctgagttgggaggatcacctgagcctgagaagtcaaggctgcagtgagctctgattatgccactgcactctagcctgggtgacagagtgagaccctgtctcaa

SEQ ID NO: 10208 - DNA, 508 bp, Homo sapiens
taaatgaaatgatgacaggcctgatctggtagaccctaaataagaatagcatttacatagacttcctgtgtcccacactggtctaagagtttagggtttttgttgtttgtttttagctcattttatcttcccagcgcccctgtgcagtggttatcatttcccttgttttatagaggagacaactgaggctcaacaagattaaataactagcccaaagtctatcccaggacttgaagcagagtccctgttcttaaccactgccccagctgctcagtgagtacccccacccctgcttattctacctacctcctgatgcccatctcctgccattaacagtcagatgtgcttatgctctgtgtagggccatatttctggaaacagagcccctgcttccaaagagcagcttacttaggaagtgaaagtggcagctcactcctcctgtcgcctcctcccacttccagataacattaaacctcatccattgcttaggctggttaatatcaactgg

SEQ ID NO: 10209 - DNA, 438 bp, Homo sapiens
cctctgcctccctggttcaagcgattctcctgcctcagcctcccaagtaggtgggactacaggtgtgtgccatcacgcctagctaatttttgtattttcagtagagatgggtttcaccatgttggccaggctagtctcaaactcctgacctcaggcaatccgcctgcctctgcctcccaaagtgctgggattacaggcatgagccacagtgcccggccagagaagaattttaaataggcttccagccaatgagattatgagacaaaatctttaggaggtaaagaatattagtcatttttacacattcgtataactatactcccaagggaaaaagaaaaaggcactagcagcgttgaggggaagcatctatggcaatatttttagagactgttcatattttacttataattagcccaaagtggcaacctattaaaaaaa

SEQ ID NO: 10210 - DNA, 455 bp, Homo sapiens
aagtcgacccccacgtggcctgctgccacctgagccaggtgtgcaaaagtttgcattgcttcagatggtggtgtctgaacacaaagcacttttcagaagcgtctaaatacaatgcagcctggaataacaatggtaaatttaaaatctcacttaacccagaagtgcgctttgtggtcattctacctgattacttgtggggggcctaaaagtgggcttttctgatagagaagagagcctgctgatgtggtaatttgctgggttaaaaactttaaaagtgtagcagaagcatagcaagtgctcttttccttttcacagtgcagtcagtggagaaaggggaatgcacaccaatatgtgaatatccaattccttctattcaaaacatgttgccttacatagcacacacagcttaataccttccaaagatattaaattcctgaatggtaaaactagatgga

SEQ ID NO: 10211 - DNA, 935 bp, Homo sapiens
gggttccttaacaaacgtaatccagcaccagattagtattggtgttaggctgtctggagcctaattgctcacacgcttccaacagaatctgagccttgaatttttcttctttaaaaacacaactttgtccttttttttttttttccttccttttctcagtctttaaatatggctttttacaaatatttaaaagatgatttgttttgtggaaatgtcacttgtttttctccaaattaattttcatcttgtataattctgaatagtccatttccagcatttcccttttgtatatgaggaagtaagtttttgcaagaaattctgtgaagttagcactgctgtcaatgttcacactcttttcatgtagcagtgtacccgcatttgaatctttctgttacattattttggaattttaggtttcaaacagtgtatctttctaaaatccgtttttttgacattgtaattttctgtggcaagacactataaactctcaccaggttcttggattgggtatgattcacaggaattgaatgttagtaatctggggctgtcctctttatcattaaaaatgagtttttacaactggtgacaagctgattgctgacctttctttagaaatcaagaaattgtatgtcagaattaaaaataggaaatctgatttaattgtagagggtctatcaactgcttagacagagatagtaagattcaatttaagtaaatgtttataaccatagttatgcgcatcagttttacttgcaaggagaaaaatgagaaatcacgactcattccagaatttactgtttttccttcctgcttaatggttggaggaggaggaatggagaatacgttgtgatcattcagtaagagcctgaaggaaagttgtatgaagtaacgtaaaccacatattagcaagattataatccattaattgacttttc

SEQ ID NO: 10212 - DNA, 657 bp, Homo sapiens
atttgtacattgaggataataatagcatttatatcttagagctgggatcaatatacataaaatgcttagagtagtgcttggcacataataagtatttatcattattatggctgttgctattatcttaggcacccggaggaattagaacaatctttgatcccaaggaacctaaaatcaattatattctttattataaaaatattctttatttgaaaaatctctctggggagaaaaaccatctcaacatttctgaagcaacctatcaatagtaaacaaaaataatacttaagagtatgtaaatttgtgacaagagtggagtatagtggaccaagaaagattgcttcagaaggtatgagttttgaatgtgatctcaagtttcgatgggtatgattggcaggaggggaagctttctgggtggtcagagtgacttgatcagagagatgcagaggaattgacagaaaataatgggcttgactacagtcaggagacacaggtggagctctaagtcatagtctgtgtgtttatacacagaatataactctgccaggggctgtggagaatgcaaggtgcaactaagcatttagctgggggtcactgggcacaaaggtgaggatgctggcagggaaggggaaggagtcagggtagcggtgaacctag

SEQ ID NO: 10213 - DNA, 564 bp, Homo sapiens
  misc_feature (430)..(430): n is a, c, g, or t
ctttagctttggccagctgcacagttgaggaggctctgctggcctgattttggaaaaccaagccctgtttggtgaagctcctcaggtgacactgtctgaaacggagttgtttggatttgttatttctaccactgtgccttcttgcgtcactgtgttttgatttgtggtcaacaaaacactttcaaatagccttaggtgagtaagcctgcaagtgacagcaagaaattctaccgaatgaaactcaagaggcagaaaatcactatcataccaatgggagctcatttgtcaattccttcctgtgcatccaaccatcacgatcttatttgacattcgcagtagccctaaggggaacggcacctgcattgctcccctttcataatgggaatatgttcagagggaaactaggcccctattcgacagggagaacttngatgggttaacagggatagtatatcctcataggccaaattcttttcaccaaggaagtttttatgggcaaacacttgttaggccagggccctgcatgtttgtggataatcctagctaagtatcagataaagaaag

SEQ ID NO: 10214 - DNA, 239 bp, Homo sapiens
gcttttaggtcagacagaactaggtttaaatcctggctcaggtcccttagataagatactaagaatttataggtcatacagctgttggaaggataagtaatatactgtatagaaagtgattaccacaacatctgcacaatgtcattatgtttataaaaggttcctttctgtttgtcagtgttatacttgattattcttatttgtcttctgcagcacatttggccagtgtttcgggaagt

SEQ ID NO: 10215 - DNA, 1254 bp, Homo sapiens
catcaatgagtttcttcagttcttcctccagctaaagtagtgtcactctggtcacggtgacactgctttactggaggaagaactgaagaaactcattgatgctctgatagagaattttcttcagcctagtaagaatggactgatctggcgttctgtttaggggtacaccaatacgtcatgacactgtgtgggcatatggaacagagcaaccgagaactgcatacattgaaccttgtgttagcattctctctctatctcatctggccgagtatctttttccttttattttctttctttttggtcaactggctagactaaacaaagtataagtttgaaatgaaatggtctagagggaaatgattcaaattttttcataattcaaacaaaagttattacactaaaagtattatagtaacgtattgtccttccgttaacagaaacatcacaattcaaaagtgagttttcttattatagtgtgattaagcctagttctgtatctcgtaattgtgtatagcatggtaaaagaaaaaaaaaaagacaggtaaatgttatataattgtagggttagttaaggaaattagtccataaaattggcaagaaaatggtactttccttgattgttatgaaaaagtgtcattgtgacatcacaggtattaatttacaaattagagtatttgaaataggatatttagcatttctgtagtttagaacagatgttacagtgtgtggttttggcatgtctgtttcaggtgcccttggtgcagtataaatttactgtatgtatttaaaattctgatgtttactgaacataaaacaatagtggcaacactcctattggctttgttcttatcaaatttctcagtgccttctcagggtctggtatgaacagaaaaaacagtgttcctgcatttaccataatttaatcagtcaatttgcagatagctaaggaaaatcttccaaaatctgtaggtgcttcctctatatcaagtgagtttgctgattttaaaatcttaggaatataaataaagatcttaataaaagcaagcttaatgtagttaaggatcttcatattagaattgtgtcatttatcaaaccttttattacagaaaaaaatctgaactgagaaaggagctctgaatttatttgacagtctaacttttgaattacatttttgtaagtagatttattcttttattttatgaagtaatgttaattttactaagaataaaacatccaaattttaagtattatgaa

SEQ ID NO: 10216 - DNA, 1283 bp, Homo sapiens
aatggctgtgttgctaccctccggacaagtggaacagaaccaaagataaagtattatgcagagatgtgtgcgtcacctgaccagagtgacactgctttactggaggaagaactgaagaaactcattgatgctctgatagagaattttcttcagcctagtaagaatggactgatctggcgttctgtttaggggtacaccaatacgtcatgacactgtgtgggcatatggaacagagcaaccgagaactgcatacattgaaccttgtgttagcattctctctctatctcatctggccgagtatctttttccttttattttctttctttttggtcaactggctagactaaacaaagtataagtttgaaatgaaatggtctagagggaaatgattcaaattttttcataattcaaacaaaagttattacactaaaagtattatagtaacgtattgtccttccgttaacagaaacatcacaattcaaaagtgagttttcttattatagtgtgattaagcctagttctgtatctcgtaattgtgtatagcatggtaaaagaaaaaaaaaaagacaggtaaatgttatataattgtagggttagttaaggaaattagtccataaaattggcaagaaaatggtactttccttgattgttatgaaaaagtgtcattgtgacatcacaggtattaatttacaaattagagtatttgaaataggatatttagcatttctgtagtttagaacagatgttacagtgtgtggttttggcatgtctgtttcaggtgcccttggtgcagtataaatttactgtatgtatttaaaattctgatgtttactgaacataaaacaatagtggcaacactcctattggctttgttcttatcaaatttctcagtgccttctcagggtctggtatgaacagaaaaaacagtgttcctgcatttaccataatttaatcagtcaatttgcagatagctaaggaaaatcttccaaaatctgtaggtgcttcctctatatcaagtgagtttgctgattttaaaatcttaggaatataaataaagatcttaataaaagcaagcttaatgtagttaaggatcttcatattagaattgtgtcatttatcaaaccttttattacagaaaaaaatctgaactgagaaaggagctctgaatttatttgacagtctaacttttgaattacatttttgtaagtagatttattcttttattttatgaagtaatgttaattttactaagaataaaacatccaaattttaagtattatgaa

SEQ ID NO: 10217 - DNA, 682 bp, Homo sapiens
  misc_feature (604)..(604): n is a, c, g, or t
aatggctgtgttgctaccctccggacaagtggaacagaaccaaagataaagtattatgcagagatgtgtgcgtcacctgaccagagtgacactgctttactggaggaagaactgaagaaactcattgatgctctgatagagaattttcttcagcctagtaagaatggactgatctggcgttctgtttaggggtacaccaatacgtcatgacactgtgtgggcatatggaacagagcaaccgagaactgcatacattgaaccttgtgttagcattctctctctatctcatctggccgagtatctttttccttttattttctttctttttggtcaactggctagactaaacaaagtataagtttgaaatgaaatggtctagagggaaatgattcaaattttttcataattcaaacaaaagttattacactaaaagtattatagtaacgtattgtccttccgttaacagaaacatcacaattcaaaagtgagttttcttattatagtgtgattaagcctagttctgtatctcgtaattgtgaaaaaatttgaatcatttccctctagaccatttcatttcaaacttatactttgtttagtctagccngttgaccaaaaagaaagaaaataaaaggaaaaagatactcggccagatgtcgacgcggccgcgaatttagtagtagta

SEQ ID NO: 10218 - DNA, 465 bp, Homo sapiens
tactactaaaatcgcggccgcgtcgacagtttatatcagatgttatgttaaagtgttgcaaagaccactgaagaaggtgaatggggactctggtctcctacctaccactggttcttcatctagaacatctctaattgtatctgttttgtataatctttcatttgaacaaagggttctaaggttaaaaacagaagattacggctgggcgcagtggctcatgcctacagaccgaggcgggtggatcatgatgaggtcaggagttcgagaccagcctggccagcatggtgaagccccatctctcctaggaatacaaaaattggctgagcgtggtggcaggtgcctgtagtcccagctactcaggaggctggggcggagaattgcttgaacccgggaggtggagattgcattgagccgagatcacgccactgcactccagcctgggtgacagagcaagactcagtctca

SEQ ID NO: 10219 - DNA, 738 bp, Homo sapiens
aagaatgatgagaaggattccatcagtatttgtttttatattactactggtattttaatccctttgtcctactttcagatactttatcaccaaaacacaacatatatacatcactctctcatgccaaatttaaggctttgaaggagtaaaaagttactgtttaccacagggatttggaaatgaatgagtttctggtggctgctctaataaactgctacaagcttagtggttttaaataatacagatttattattttacggttctggatgtcaggagtccaaaatgagtcttaaaggactaagatcaaaatgtctacagggctggttcctgtggaagctccagggcagaatctgttgcttgtttctttcacttccagaggctgccagcattccttggcttctggctgcgtcactatgatctctgtttccatgatcacattaccttcccctctaatgtacttaaatctccttcagtttccatctttttttttagacggagtttcactcttgctgcccaggctagagtgcaatggcacgatctcagctcactgcactttctgcctcccgggttcaagtgattcttctgcctcagcactttgggaggctgaggtaggaggatcacttgagctcaggagttcgagaccagcctgggcaacatagtgagacctggtctctattaaataaataagtacatgaccaaataacatagcaagacctcgtctctattaaataaatacat

SEQ ID NO: 10220 - DNA, 704 bp, Homo sapiens
aagaatgatgagaaggattccatcagtatttgtttttatattactactggtattttaatccctttgtcctactttcagatactttatcaccaaaacacaacatatatacatcactctctcatgccaaatttaaggctttgaaggagtaaaaagttactgtttaccacagggatttggaaatgaatgagtttctggtggctgctctaataaactgctacaagcttagtggttttaaataatacagatttattattttacggttctggatgtcaggagtccaaaatgagtcttaaaggactaagatcaaaatgtctacagggctggttcctgtggaagctccagggcagaatctgttgcttgtttctttcacttccagaggctgccagcattccttggcttctggctgcgtcactatgatctctgtttccatgatcacattaccttcccctctaatgtacttaaatctccttcagtttccatctttttttttagacggagtttcactcttgctgcccaggctagagtgcaatggcacgatctcagctcactgcactttctgcctcccgggttcaagtgattcttctgcctcagctactcaggaggctggggcggagaattgcttgaacccgggaggtggagattgcattgagccgagatcacgccactgcactccagcctgggtgacagagcaagactcagtctca

SEQ ID NO: 10221 - DNA, 312 bp, Homo sapiens
gggtctgtgaacttgtttgggggaaaaatattatatcttttcattaacctataactaaaacttggaatttcattcaaatatgagtgtaggcaacaaaccatagttgtattagcagtacctgtgactttgtcaccagtagaaatcatgtacttcataccataatgcagctgttatagctatcttgaaattgtttaagcttatcactacctcaaaattagtgtgattattagacccactgctggatcttattttattttttaaaagcacattgttaattgcaattaaagtattttgacagttctatctttgcat

SEQ ID NO: 10222 - DNA, 348 bp, Homo sapiens
cacattctcctggctcttctcctttccagtcaccttttctgctcctcttccttttctggataaatccaggtgttctctaggactcttctctcagtgcttctttggtcttgctgctctaccctcttgacctgggctttctaaggtacccatggcctcaaccaccaccacagtctaacaagtccaaatctcctgtattattatttcagagtagcagcatcatagcatcactgtctacatggtctgatccatcctcctcctttatcccctgtgtccaattagtgaccaaatccctaattaagtcttgccccctgtcttagtctgttttatgataccataactgaataccac

SEQ ID NO: 10223 - DNA, 573 bp, Homo sapiens
aaatcttcattctcagcatcttggctatttcatttgactagggcattaccaaaaacaacagtaatctgctggcaacatctcagctacctaagcatgtgattaaaggtggaggaaacaagatcctgatcaaaatataagaggaattcttagaaaactggaaaacatacgcagctttgaaaagctacaacatatttttggggatctagaagactttgcaaattcctagaaaggaaaacacctcattcaaataatcagctcccttctgcttcaccatgaagccctgcgtaagcaggaaatgaaaactaaggctgtcattttctgaactttgaaggcatgccttcacacacaaatcactttgacaaagggtgggagatgtacaggcaagagatttagggaaatcttacaacaaatcactggctgaccactaaataatactgacccaggtatgccaagtaggaagccagatgtagaataaaaactttaaaaataaaaattaaaaagaccctggggcaactgctgcagggaatacagaatccacagaattcactacatgaaaaaaaaaaaaaagtcact

SEQ ID NO: 10224 - DNA, 500 bp, Homo sapiens
caaccccagacatgccatctcctgtgctcggcctgtgcccactctcatcgatgcacactgctgccatattgtttgttagatgtcgtgaacactagccctgctcacaggtaaaacttggaaggggactcaccatatgagcttctttgtctagtgtcactcccacagggtgcctttaggcctttatgtccaggagcacataactgtctctcactgatttttcctctgcttgaaaggtacccaggaaatgaagtttatgaactgggcgtcctgttttctttccatccatatgtccctgggaaagttattaaactctctgagacttagtttcctccactcacaaggatggtaatttctgcctcactgagatcttatgatgaataaatgaaattgtaagtagaaggtgccaggcacagtacttgacacataacaggccctcagtgcaactaaggcccactgttgtgaaccagtgttttcttaaatgtctaaaagagttacatact

SEQ ID NO: 10225 - DNA, 370 bp, Homo sapiens
ttctaaatccaatccaatcctatgcccctcctgcctgcaattactggggctctcctccccaccaccaccttcccatttggtgaaagggtgtggcctttggtctctggtggctcccatggttactgatgcacttcctgttagggagcaatggttggtgcaatgccatctgtcaaacactgctcttgtgatgggccacacagatgtccctcaaggtgtttctctcaccaactgcaggcttagccacacgctgctgctttcaaggccacagggcttaatgatcagtcaccagagatagctgcatgcaagttctctgccagccccaggtggaaggttttctaagaaaggtggagtggctgtatttttatattca

SEQ ID NO: 10226 - DNA, 5885 bp, Homo sapiens
ctctgcctttcctctcgcagccacccttcctctcagaccagtacggtggccgacgggagtcagacgctggggatgaatgaaggatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtgcacctgctgaccagagccaaagctgggctcaggataagaaactcatccttcgccttctttctggagtggaagctgtcaactccattgttgcattgttgtccgtggactttcatgctttagaacaagatgccagcaaagaacagcagcttaggcataaacttggaggaggcagtggagagagcatcctggtatcacagcttcagcatggactgacgttagagtttgaacacagtgattcacctcgtcgattgcgtcttgtgcttagtgaactgttggcaattatgaacaaggtgtctgagtccaacggagaattttttttcaagtcttctgaactttttgagagtccagtatatttggaggaagctgcagatgtactttgtattttacaagcagagctcccttccttgctccctatagttgatgtagctgaagctttgctacatgttagaaatggtgcctggttcttgtgtctcttggtggccaatgttcctgatagttttaatgaagtttgtaggggcctgataaaaaatggagaacgacaagatgaagaaagtcttggaggaaggcgcaggacagatgccttacgcttcttgtgtaaaatgaatccttctcaggccctcaaggtccgaggcatggtggtggaagaatgtcacttgccaggccttggtgtggctttgacattggatcatactaaaaatgaagcttgtgaggatggagtgagtgacttggtttgttttgtaagtggtttgcttcttggaacaaatgcgaaagtccggacttggtttggaacttttatccgaaatggacagcagagaaaaagagagaccagcagttctgtcctttggcagatgagaaggcagcttcttctggagttgatgggcattcttcccacagtaagaagcacccgaattgtggaagaagctgatgtggatatggagcccaatgtgtctgtgtattcggggctgaaagaagagcatgttgtgaaagccagtgcactcttacgtctgtactgtgctttgatggggatcgctggactcaaaccaactgaagaagaagctgagcaattactgcagttgatgacgagccgtcctcctgctacgccagctggggttcgctttgtttcactttccttttgtatgctactggccttttctacacttgtcagtacacctgaacaggagcagctgatggtggtgtggctaagttggatgataaaagaagaagcgtattttgagagtacttcaggcgtctctgcttcttttggggagatgttattattggtggctatgtactttcacagcaaccagcttagtgctatcattgacttggtctgttccactttggggatgaagattgtaattaagccaagctccttgagcaggatgaagacaatcttcacacaggaaatttttactgagcaggttgtcacagctcatgcagttcgggtccctgtcaccagcaacctgagtgccaacattactggatttttgcctattcattgtatttaccagcttctcaggagccgttcctttaccaagcacaaagtgtcaataaaagattggatttatagacagctgtgtgaaacctctactccacttcatcctcaattacttcctttgattgatgtgtacataaattctatacttactcctgcgtcgaaatctaatccagaagccacaaatcagccagtcacagaacaggagatactcaatattttccaaggagtcattgggggtgacaacatccgccttaatcagcgtttcagtatcacagcacagcttttggtgctctactatatactgtcttatgaagaggctcttctagcaaacacgaagactttagctgccatgcaaagaaagcccaaatcatattcttcttctttaatggatcagattcctatcaaattccttattcgacaggctcaagggctgcagcaggagttgggagggttgcattcagctttactacgtctccttgctactaactacccacatttatgtattgtggatgactggatttgtgaagaagaaatcacagggactgatgccctgctacggcgaatgctcctgactaataatgctaaaaatcattctcccaaacaactccaagaagcattttcagctgtcccagtaaatcacacacaagtgatgcagattatagaacacttgactctactctctgccagtgaacttataccatatgcggaagtgttaacatccaatatgagccagctattgaattcaggggttccacggagaattctgcaaacagtcaataaactatggatggttcttaatactgtgatgcctagaaggctatgggtaatgacggttaatgcacttcagccttcaataaagtttgtacgacaacaaaagtatactcagaatgacctgatgatagatcctctcattgtcctaaggtgtgatcagagggttcacagatgccccccactgatggatattaccctacacatgttgaatggatatcttcttgcatctaaagcctaccttagtgctcatctgaaggaaacagagcaagataggccttcccagaataatacaattggtttagttggacaaactgatgctccggaagttaccagggaagaattgaaaaatgcattactggccgctcaggatagtgcagctgtccagattctcttagagatttgcctacctactgaagaggagaaagcaaatggtgtcaatccagatagcttgttaagaaatgttcaaagtgttattaccaccagcgctccaaataagggaatggaggaaggagaagacaatttgctctgtaaccttcgagaagttcagtgccttatctgttgtctcttgcaccaaatgtacattgcagatcccaacattgctaagcttgttcactttcagggttatccatgtgaacttttgcctctgacggtcgcaggtattccatctatgcacatctgtctagatttcatacctgagcttattgcacagccagaacttgagaaacagatatttgctatccagttgctttctcacttgtgtatacaatatgcattaccaaagtcacttagtgtggctcgtttagctgtcaatgtcatgggaactttgttaacagttttaacacaggctaagcggtatgctttttttatgccaactctgccaagtttggtctctttttgtcgagcatttcctccattgtatgaggatattatgtctttgctgatccaaatagggcaagtttgtgcctctgatgttgccactcagacaagagacattgatccaattattacacgtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagcttttgaagtgaagactgccatgcctttaatttcttataaaaatgagtctgtgggtagccctagtgtttattttaactgtgagcttgtaacagaatgtgacaaagatgcaaagatgggagaggaaaaaagggtaaagggaaaggagaattaaggaaataataggagttaaaaacacaagtagaaatctcaaagatttgcagtgcaagtaatagtaatgcaagttggaattctagttctcaagaaagagtattgagaagacttttaaaaaggcaagtagcttttgtaaatgatttctgtggaaatacagatgaggatttaaagatttcacatatttgcttcaatttttattaatatatgaagccatatgtttaaagagatacttgaataatttggaattttaagatactggtgtaaaagtgtttacagaaacatctttgttcaaagaagaacctgagagatctcatttagttttatgttttaaatttatttttataatgctttattaacttacctaatgctcagaggggggaaatatgtatcaaattaaatgaaggtagagcaataaaacccactggattaaagagctcttggtttgtcatcaggattataattcatatcttactttgagaagatctttgagtaagaaaatgcagtgtttgaacctgaggaaaagttaaagtgtagaaaatattgtcttgccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtagagacgggggtttgccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctccttttttttttaaactgaggccttgcgatattttgtgtgaatagatatgccctaggagttcagaaaaagttaaaagtatgttttctaattaaatgcagtgcacattcctggatcaatattcaaagactggtcataacctgctgtgttaaaataatcacatatgctctttttcatcagatttgttgatgatgtaaataaaatgtgtaaatatattagtaaatgttaatattcatgtattttaagttaaggttataaaatttgtcacaatgtgtttttttattcaagtgaaaacagatgtgtgcagctattttgaatattggtttataaacattcatattctttatcaaacgaaaaaa

SEQ ID NO: 10227 - DNA, 5959 bp, Homo sapiens
ctgctagtcggtcggccttgagaggggactgctttggctgccagctcactgcctttttgtttactttttgtgccttggatgattcctggagacagagaagtgcgctaatgagacgcgtctttctcacatagcacccacacatctgctttttacccggatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtgcacctgctgaccagagccaaagctgggctcaggataagaaactcatccttcgccttctttctggagtggaagctgtcaactccattgttgcattgttgtccgtggactttcatgctttagaacaagatgccagcaaagaacagcagcttaggcataaacttggaggaggcagtggagagagcatcctggtatcacagcttcagcatggactgacgttagagtttgaacacagtgattcacctcgtcgattgcgtcttgtgcttagtgaactgttggcaattatgaacaaggtgtctgagtccaacggagaattttttttcaagtcttctgaactttttgagagtccagtatatttggaggaagctgcagatgtactttgtattttacaagcagagctcccttccttgctccctatagttgatgtagctgaagctttgctacatgttagaaatggtgcctggttcttgtgtctcttggtggccaatgttcctgatagttttaatgaagtttgtaggggcctgataaaaaatggagaacgacaagatgaagaaagtcttggaggaaggcgcaggacagatgccttacgcttcttgtgtaaaatgaatccttctcaggccctcaaggtccgaggcatggtggtggaagaatgtcacttgccaggccttggtgtggctttgacattggatcatactaaaaatgaagcttgtgaggatggagtgagtgacttggtttgttttgtaagtggtttgcttcttggaacaaatgcgaaagtccggacttggtttggaacttttatccgaaatggacagcagagaaaaagagagaccagcagttctgtcctttggcagatgagaaggcagcttcttctggagttgatgggcattcttcccacagtaagaagcacccgaattgtggaagaagctgatgtggatatggagcccaatgtgtctgtgtattcggggctgaaagaagagcatgttgtgaaagccagtgcactcttacgtctgtactgtgctttgatggggatcgctggactcaaaccaactgaagaagaagctgagcaattactgcagttgatgacgagccgtcctcctgctacgccagctggggttcgctttgtttcactttccttttgtatgctactggccttttctacacttgtcagtacacctgaacaggagcagctgatggtggtgtggctaagttggatgataaaagaagaagcgtattttgagagtacttcaggcgtctctgcttcttttggggagatgttattattggtggctatgtactttcacagcaaccagcttagtgctatcattgacttggtctgttccactttggggatgaagattgtaattaagccaagctccttgagcaggatgaagacaatcttcacacaggaaatttttactgagcaggttgtcacagctcatgcagttcgggtccctgtcaccagcaacctgagtgccaacattactggatttttgcctattcattgtatttaccagcttctcaggagccgttcctttaccaagcacaaagtgtcaataaaagattggatttatagacagctgtgtgaaacctctactccacttcatcctcaattacttcctttgattgatgtgtacataaattctatacttactcctgcgtcgaaatctaatccagaagccacaaatcagccagtcacagaacaggagatactcaatattttccaaggagtcattgggggtgacaacatccgccttaatcagcgtttcagtatcacagcacagcttttggtgctctactatatactgtcttatgaagaggctcttctagcaaacacgaagactttagctgccatgcaaagaaagcccaaatcatattcttcttctttaatggatcagattcctatcaaattccttattcgacaggctcaagggctgcagcaggagttgggagggttgcattcagctttactacgtctccttgctactaactacccacatttatgtattgtggatgactggatttgtgaagaagaaatcacagggactgatgccctgctacggcgaatgctcctgactaataatgctaaaaatcattctcccaaacaactccaagaagcattttcagctgtcccagtaaatcacacacaagtgatgcagattatagaacacttgactctactctctgccagtgaacttataccatatgcggaagtgttaacatccaatatgagccagctattgaattcaggggttccacggagaattctgcaaacagtcaataaactatggatggttcttaatactgtgatgcctagaaggctatgggtaatgacggttaatgcacttcagccttcaataaagtttgtacgacaacaaaagtatactcagaatgacctgatgatagatcctctcattgtcctaaggtgtgatcagagggttcacagatgccccccactgatggatattaccctacacatgttgaatggatatcttcttgcatctaaagcctaccttagtgctcatctgaaggaaacagagcaagataggccttcccagaataatacaattggtttagttggacaaactgatgctccggaagttaccagggaagaattgaaaaatgcattactggccgctcaggatagtgcagctgtccagattctcttagagatttgcctacctactgaagaggagaaagcaaatggtgtcaatccagatagcttgttaagaaatgttcaaagtgttattaccaccagcgctccaaataagggaatggaggaaggagaagacaatttgctctgtaaccttcgagaagttcagtgccttatctgttgtctcttgcaccaaatgtacattgcagatcccaacattgctaagcttgttcactttcagggttatccatgtgaacttttgcctctgacggtcgcaggtattccatctatgcacatctgtctagatttcatacctgagcttattgcacagccagaacttgagaaacagatatttgctatccagttgctttctcacttgtgtatacaatatgcattaccaaagtcacttagtgtggctcgtttagctgtcaatgtcatgggaactttgttaacagttttaacacaggctaagcggtatgctttttttatgccaactctgccaagtttggtctctttttgtcgagcatttcctccattgtatgaggatattatgtctttgctgatccaaatagggcaagtttgtgcctctgatgttgccactcagacaagagacattgatccaattattacacgtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagcttttgaagtgaagactgccatgcctttaatttcttataaaaatgagtctgtgggtagccctagtgtttattttaactgtgagcttgtaacagaatgtgacaaagatgcaaagatgggagaggaaaaaagggtaaagggaaaggagaattaaggaaataataggagttaaaaacacaagtagaaatctcaaagatttgcagtgcaagtaatagtaatgcaagttggaattctagttctcaagaaagagtattgagaagacttttaaaaaggcaagtagcttttgtaaatgatttctgtggaaatacagatgaggatttaaagatttcacatatttgcttcaatttttattaatatatgaagccatatgtttaaagagatacttgaataatttggaattttaagatactggtgtaaaagtgtttacagaaacatctttgttcaaagaagaacctgagagatctcatttagttttatgttttaaatttatttttataatgctttattaacttacctaatgctcagaggggggaaatatgtatcaaattaaatgaaggtagagcaataaaacccactggattaaagagctcttggtttgtcatcaggattataattcatatcttactttgagaagatctttgagtaagaaaatgcagtgtttgaacctgaggaaaagttaaagtgtagaaaatattgtcttgccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtagagacgggggtttgccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctccttttttttttaaactgaggccttgcgatattttgtgtgaatagatatgccctaggagttcagaaaaagttaaaagtatgttttctaattaaatgcagtgcacattcctggatcaatattcaaagactggtcataacctgctgtgttaaaataatcacatatgctctttttcatcagatttgttgatgatgtaaataaaatgtgtaaatatattagtaaatgttaatattcatgtattttaagttaaggttataaaatttgtcacaatgtgtttttttattcaagtgaaaacagatgtgtgcagctattttgaatattggtttataaacattcatattctttatcaaacgaaaaaa

SEQ ID NO: 10228 - DNA, 506 bp, Homo sapiens
aagatgcattggaatcatgaagctctaggccgtatgttcatgatcacatttgatcttgtcattaggttttggaaaatcttgactcacttgttggttcttttagtgtagggcacttttgcacatggcttctctcaacctgttatgaattttcttctgtctagttttaaatttcaggacattttccagatcttgctccaggtatgttcttgttcttcctgtgtagccacttgttttcgtaatgattcttcatcttttatatgctatattcgcaggttaattgcattaaaagtaatttgactttgtttttgtttccatttgggttgaaggttaagatttctgttgtttctggacattttatttattttacactttttatctttgatagctgccatgcaaagaaagcccaaatcatattcttcttctttaatggatcagattcctatcaaattccttattcgacaggctcaagggctgcagcaggagttgggaggtatgttttattttgc

SEQ ID NO: 10229 - DNA, 6166 bp, Homo sapiens
ctctgcctttcctctcgcagccacccttcctctcagaccagtacggtggccgacgggagtcagacgctggggatgaatgaaggtgctgggtgcaggttgaaaaagtctcccgcttttccgttcctacagtcccggttctgcctttgtgtggtgcccccatccttcccactttgtatcgacaacccggttggtcccggcgtctgagttcttggtgtccgagtcgactcgaggcacaactagggtttggggttccggatatcgcctaggcccaacatcggaccgcgctctcgatttctgccgcgtcccgcctctaggacgcggagtccgtgtgcggttccgtgaggctggagggtagatcttaaggatcaacaaacagtaataatgactgaatgtacaagtcttcagtttgtcagcccttttgcttttgaggcaatgcagaaggtggatgttgtttgcctggcatctttaagtgatccagaattaagacttcttctgccctgtttggtacggatggcactttgtgcacctgctgaccagagccaaagctgggctcaggataagaaactcatccttcgccttctttctggagtggaagctgtcaactccattgttgcattgttgtccgtggactttcatgctttagaacaagatgccagcaaagaacagcagcttaggcataaacttggaggaggcagtggagagagcatcctggtatcacagcttcagcatggactgacgttagagtttgaacacagtgattcacctcgtcgattgcgtcttgtgcttagtgaactgttggcaattatgaacaaggtgtctgagtccaacggagaattttttttcaagtcttctgaactttttgagagtccagtatatttggaggaagctgcagatgtactttgtattttacaagcagagctcccttccttgctccctatagttgatgtagctgaagctttgctacatgttagaaatggtgcctggttcttgtgtctcttggtggccaatgttcctgatagttttaatgaagtttgtaggggcctgataaaaaatggagaacgacaagatgaagaaagtcttggaggaaggcgcaggacagatgccttacgcttcttgtgtaaaatgaatccttctcaggccctcaaggtccgaggcatggtggtggaagaatgtcacttgccaggccttggtgtggctttgacattggatcatactaaaaatgaagcttgtgaggatggagtgagtgacttggtttgttttgtaagtggtttgcttcttggaacaaatgcgaaagtccggacttggtttggaacttttatccgaaatggacagcagagaaaaagagagaccagcagttctgtcctttggcagatgagaaggcagcttcttctggagttgatgggcattcttcccacagtaagaagcacccgaattgtggaagaagctgatgtggatatggagcccaatgtgtctgtgtattcggggctgaaagaagagcatgttgtgaaagccagtgcactcttacgtctgtactgtgctttgatggggatcgctggactcaaaccaactgaagaagaagctgagcaattactgcagttgatgacgagccgtcctcctgctacgccagctggggttcgctttgtttcactttccttttgtatgctactggccttttctacacttgtcagtacacctgaacaggagcagctgatggtggtgtggctaagttggatgataaaagaagaagcgtattttgagagtacttcaggcgtctctgcttcttttggggagatgttattattggtggctatgtactttcacagcaaccagcttagtgctatcattgacttggtctgttccactttggggatgaagattgtaattaagccaagctccttgagcaggatgaagacaatcttcacacaggaaatttttactgagcaggttgtcacagctcatgcagttcgggtccctgtcaccagcaacctgagtgccaacattactggatttttgcctattcattgtatttaccagcttctcaggagccgttcctttaccaagcacaaagtgtcaataaaagattggatttatagacagctgtgtgaaacctctactccacttcatcctcaattacttcctttgattgatgtgtacataaattctatacttactcctgcgtcgaaatctaatccagaagccacaaatcagccagtcacagaacaggagatactcaatattttccaaggagtcattgggggtgacaacatccgccttaatcagcgtttcagtatcacagcacagcttttggtgctctactatatactgtcttatgaagaggctcttctagcaaacacgaagactttagctgccatgcaaagaaagcccaaatcatattcttcttctttaatggatcagattcctatcaaattccttattcgacaggctcaagggctgcagcaggagttgggagggttgcattcagctttactacgtctccttgctactaactacccacatttatgtattgtggatgactggatttgtgaagaagaaatcacagggactgatgccctgctacggcgaatgctcctgactaataatgctaaaaatcattctcccaaacaactccaagaagcattttcagctgtcccagtaaatcacacacaagtgatgcagattatagaacacttgactctactctctgccagtgaacttataccatatgcggaagtgttaacatccaatatgagccagctattgaattcaggggttccacggagaattctgcaaacagtcaataaactatggatggttcttaatactgtgatgcctagaaggctatgggtaatgacggttaatgcacttcagccttcaataaagtttgtacgacaacaaaagtatactcagaatgacctgatgatagatcctctcattgtcctaaggtgtgatcagagggttcacagatgccccccactgatggatattaccctacacatgttgaatggatatcttcttgcatctaaagcctaccttagtgctcatctgaaggaaacagagcaagataggccttcccagaataatacaattggtttagttggacaaactgatgctccggaagttaccagggaagaattgaaaaatgcattactggccgctcaggatagtgcagctgtccagattctcttagagatttgcctacctactgaagaggagaaagcaaatggtgtcaatccagatagcttgttaagaaatgttcaaagtgttattaccaccagcgctccaaataagggaatggaggaaggagaagacaatttgctctgtaaccttcgagaagttcagtgccttatctgttgtctcttgcaccaaatgtacattgcagatcccaacattgctaagcttgttcactttcagggttatccatgtgaacttttgcctctgacggtcgcaggtattccatctatgcacatctgtctagatttcatacctgagcttattgcacagccagaacttgagaaacagatatttgctatccagttgctttctcacttgtgtatacaatatgcattaccaaagtcacttagtgtggctcgtttagctgtcaatgtcatgggaactttgttaacagttttaacacaggctaagcggtatgctttttttatgccaactctgccaagtttggtctctttttgtcgagcatttcctccattgtatgaggatattatgtctttgctgatccaaatagggcaagtttgtgcctctgatgttgccactcagacaagagacattgatccaattattacacgtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagcttttgaagtgaagactgccatgcctttaatttcttataaaaatgagtctgtgggtagccctagtgtttattttaactgtgagcttgtaacagaatgtgacaaagatgcaaagatgggagaggaaaaaagggtaaagggaaaggagaattaaggaaataataggagttaaaaacacaagtagaaatctcaaagatttgcagtgcaagtaatagtaatgcaagttggaattctagttctcaagaaagagtattgagaagacttttaaaaaggcaagtagcttttgtaaatgatttctgtggaaatacagatgaggatttaaagatttcacatatttgcttcaatttttattaatatatgaagccatatgtttaaagagatacttgaataatttggaattttaagatactggtgtaaaagtgtttacagaaacatctttgttcaaagaagaacctgagagatctcatttagttttatgttttaaatttatttttataatgctttattaacttacctaatgctcagaggggggaaatatgtatcaaattaaatgaaggtagagcaataaaacccactggattaaagagctcttggtttgtcatcaggattataattcatatcttactttgagaagatctttgagtaagaaaatgcagtgtttgaacctgaggaaaagttaaagtgtagaaaatattgtcttgccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtagagacgggggtttgccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctccttttttttttaaactgaggccttgcgatattttgtgtgaatagatatgccctaggagttcagaaaaagttaaaagtatgttttctaattaaatgcagtgcacattcctggatcaatattcaaagactggtcataacctgctgtgttaaaataatcacatatgctctttttcatcagatttgttgatgatgtaaataaaatgtgtaaatatattagtaaatgttaatattcatgtattttaagttaaggttataaaatttgtcacaatgtgtttttttattcaagtgaaaacagatgtgtgcagctattttgaatattggtttataaacattcatattctttatcaaacgaaaaaa

SEQ ID NO: 10230 - DNA, 4193 bp, Homo sapiens
tttttataagatgcattggaatcatgaagctctaggccgtatgttcatgatcacatttgatcttgtcattaggttttggaaaatcttgactcacttgttggttcttttagtgtagggcacttttgcacatggcttctctcaacctgttatgaattttcttctgtctagttttaaatttcaggacattttccagatcttgctccaggtatgttcttgttcttcctgtgtagccacttgttttcgtaatgattcttcatcttttatatgctatattcgcaggttaattgcattaaaagtaatttgactttgtttttgtttccatttgggttgaaggttaagatttctgttgtttctggacattttatttattttacactttttatctttgatagctgccatgcaaagaaagcccaaatcatattcttcttctttaatggatcagattcctatcaaattccttattcgacaggctcaagggctgcagcaggagttgggagggttgcattcagctttactacgtctccttgctactaactacccacatttatgtattgtggatgactggatttgtgaagaagaaatcacagggactgatgccctgctacggcgaatgctcctgactaataatgctaaaaatcattctcccaaacaactccaagaagcattttcagctgtcccagtaaatcacacacaagtgatgcagattatagaacacttgactctactctctgccagtgaacttataccatatgcggaagtgttaacatccaatatgagccagctattgaattcaggggttccacggagaattctgcaaacagtcaataaactatggatggttcttaatactgtgatgcctagaaggctatgggtaatgacggttaatgcacttcagccttcaataaagtttgtacgacaacaaaagtatactcagaatgacctgatgatagatcctctcattgtcctaaggtgtgatcagagggttcacagatgccccccactgatggatattaccctacacatgttgaatggatatcttcttgcatctaaagcctaccttagtgctcatctgaaggaaacagagcaagataggccttcccagaataatacaattggtttagttggacaaactgatgctccggaagttaccagggaagaattgaaaaatgcattactggccgctcaggatagtgcagctgtccagattctcttagagatttgcctacctactgaagaggagaaagcaaatggtgtcaatccagatagcttgttaagaaatgttcaaagtgttattaccaccagcgctccaaataagggaatggaggaaggagaagacaatttgctctgtaaccttcgagaagttcagtgccttatctgttgtctcttgcaccaaatgtacattgcagatcccaacattgctaagcttgttcactttcagggttatccatgtgaacttttgcctctgacggtcgcaggtattccatctatgcacatctgtctagatttcatacctgagcttattgcacagccagaacttgagaaacagatatttgctatccagttgctttctcacttgtgtatacaatatgcattaccaaagtcacttagtgtggctcgtttagctgtcaatgtcatgggaactttgttaacagttttaacacaggctaagcggtatgctttttttatgccaactctgccaagtttggtctctttttgtcgagcatttcctccattgtatgaggatattatgtctttgctgatccaaatagggcaagtttgtgcctctgatgttgccactcagacaagagacattgatccaattattacacgtcttcaacaaataaaggagaaaccaagtggatggtctcaaatctgtaaagattcatcttataaaaatggatccagggacactggaagcatggatcctgatgtacagctctgtcactgtattgaaagaacagtaattgaaataataaatatgagtgttagtggaatttaaaacaaaatttaaaacaacaaaaagttgtttgctgcatatacccaacatgaatctgcatattagtaacaactctaaactgaatgggaacagtaaagtattgtcttggaatcactaaaacaattcaattcaacatgagtatagtttagaactttatgagaattatgcttgcttgtttctgattggcacatctttggatctactttgctgatatgtttctattgtagcagctgagctttttttttttccactgggaacacatgtaagaaactcattattggaaagggaatttggccttgtatttagcttttgaagtgaagactgccatgcctttaatttcttataaaaatgagtctgtgggtagccctagtgtttattttaactgtgagcttgtaacagaatgtgacaaagatgcaaagatgggagaggaaaaaagggtaaagggaaaggagaattaaggaaataataggagttaaaaacacaagtagaaatctcaaagatttgcagtgcaagtaatagtaatgcaagttggaattctagttctcaagaaagagtattgagaagacttttaaaaaggcaagtagcttttgtaaatgatttctgtggaaatacagatgaggatttaaagatttcacatatttgcttcaatttttattaatatatgaagccatatgtttaaagagatacttgaataatttggaattttaagatactggtgtaaaagtgtttacagaaacatctttgttcaaagaagaacctgagagatctcatttagttttatgttttaaatttatttttataatgctttattaacttacctaatgctcagaggggggaaatatgtatcaaattaaatgaaggtagagcaataaaacccactggattaaagagctcttggtttgtcatcaggattataattcatatcttactttgagaagatctttgagtaagaaaatgcagtgtttgaacctgaggaaaagttaaagtgtagaaaatattgtcttgccgaaggattttgcagtcctctgtcagtaacttccattgattaggcagacatattcaggtaaaccctaatcattaaaaaaaaattatcaatgtagaaagtaattcccttttttctctctgagatatacctcaatcacacacttccccacccccacttgaaacagacctcttcacttgtgttttttttttttttttcctgaggtggagtcttcccctgttgcccaggctggagtgcagtgggatgatcttggctcactgcaacttctgccacctgggttcaagggattctcgtgcctcaacctcctgagtagctgggactgcaggcacgcgccacctgtatttttgtatttttagtagagacgggggtttgccatgttgcccagactggttttgaactcctggcctcaggtgatctgcccaccttggcctcccaaagtgctgggattacaggtgtgagccaccgcacctggccagaccgcttcacttgtaaaagaaattaggctaataagaaggtgtagtttttgagaaatgaaatttaactttagccttttcactagtaaatagtcacatctcattttcttcctttgtaaaatggggttactactggccctacctcatattctatgagaatgagtttgtagctgtttcaaatcatgaagtgcatagtatcacatgtgatagaatatttataactttttattagatgcttaatgttcaattaagtaattttgatgtgaaaaataaaagtaataaaagtatcttaaaaatagcataagaattttcatatttttaaacaaggcagttttgtagtcccttaagattaaatacaactgctccttttttttttaaactgaggccttgcgatattttgtgtgaatagatatgccctaggagttcagaaaaagttaaaagtatgttttctaattaaatgcagtgcacattcctggatcaatattcaaagactggtcataacctgctgtgttaaaataatcacatatgctctttttcatcagatttgttgatgatgtaaataaaatgtgtaaatatattagtaaatgttaatattcatgtattttaagttaaggttataaaatttgtcacaatgtgtttttttattcaagtgaaaacagatgtgtgcagctattttgaatattggtttataaacattcatattctttatcaaacgaaaaaa

SEQ ID NO: 10231 - DNA, 903 bp, Homo sapiens
gtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgttttaagc

SEQ ID NO: 10232 - DNA, 866 bp, Homo sapiens
gtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaatgatgtatgtcggtcggcccttacatgacggggccaattggatccatgattggtggtctacctaccggctcgaatgtgggccggtggttcctaacaaggggccttatggttaaacaaaaac

SEQ ID NO: 10233 - DNA, 694 bp, Homo sapiens
gtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaacctaaccttttttggtgaatattggggtttgggtgttcttcatcttaatcaattcccttacaatgccatccataatttcacgctttcgagaagcctttctggctcttctccaggtcggcttggaaactctattgggccatcttgggcctcaccagattagag

SEQ ID NO: 10234 - DNA, 638 bp, Homo sapiens
ctgtggagctgatgaaatcctgcagggagcttcacggtgacagcaagaggagaaacacatccccatatgccccgcagagtttgaagtcccggctgcacctctccccagcagcaggttgactctggaaagttgcagcgttcttacctacagagtgggaacagtactacccattgcacagagtgggtgcaaagctctgtgacggaatacatggattctttgcccataaagtggagcacgaaagcaggacccagaatgggaggagcttccagaggaccggaacacttgcctttgagcgggtctacactgccaagtgagtcctaaccctgatgttgctaataagtgggggcatgggcaggggggcctccttctaggagtgatgaccacccttaataccacatgtctgtctgagccaagtttctgagcgccagggaggtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcctgtggggttagaccagggttgctactg

SEQ ID NO: 10235 - DNA, 847 bp, Homo sapiens
gtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacattcccatgcattttgtttgtttcttcacttatcctgttctctgaagatgttttgtgaccaggtttgtgttttcttaaaataaaatgcagagacatgttttaagc

SEQ ID NO: 10236 - DNA, 848 bp, Homo sapiens
gtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaatctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgttttaagc

SEQ ID NO: 10237 - DNA, 863 bp, Homo sapiens
gtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggccacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgttttaagc

SEQ ID NO: 10238 - DNA, 2349 bp, Homo sapiens
agtgggctctgcccgccgtcccccgggggctgcttcccgccccaggcctccgcggaggacacgtgtcagcacgttcccgcggttgtcattccattgtcatagcccttcccctaggccgggaacccctcccccccaccagccccagttcttttatccctgggcccaacctccccgccgacccgcggtccaggcctcggtctctctcttcggcggcgagccgcggcccagaccccggcagaggacacttgtcggcacgttctcacccctgtcatctcagccccctgcctagctccaccccaggcttgggaacccggcccctgacggcccattgtccgcgggcccagcccccgcgctgaacgcacgctcgcccttgcccctaaccagcgcgtctaccccggcaacgcgcagtgacctgggatgcagccctcaggctgggcggccgccagggaggcggcgggccgcgacatgctggccgccgacctccggtgcagcctcttcgcctcggccctgcagagctacaagcgcgactcggtgctgcggcccttccccgcgtcctacgcccgcggcgactgtaaggactttgaagccctgacatccttgttcggagaggggacctacctcaccagtgacttgagcctggccctcatatacagcccccatggccatgggtggcagcacagcctcctcggccccatccttagctgtgtggccgtgtgtgaggtcattgaccatccggacgtcaagtgccaaaccaagaagaaggattccaaggagatagatcgcagacgagcgagaatcaaacatagtgaagggggagacatccctcccaagtacttcgtggtcaccaataaccagctgctgcgagtgaagtacctcctggtgtattcacagaagccacccaagagggcttcgagccagctctcctggttttccagccattggtttaccgtcatgatatccctgtatctgctgctgctgctcatagtgagtgtcatcaactcctctgctttccaacacttttggaatcgtgcgaaaagataatctttctgggcctggtgtgggggctacctcaactatgtgccttatggtaacttgttctgtacctcctatgcctcatgtccagccaggttgagcctaggggccagttgggggaccacaggacaattttcatatggcctaaatgtatccattgcctttgatgatgttcccagccatactccagtcaacggggactactagtccctcactcttaggttttaggggagtccttccatctgctccttcttaaactgtcctagggagttggcttttcagccagggccaaaggaaaaagccctgctgcatttaaaaacaaagtgtccaagctgtcagtggtgtgtttacaatctctcctggcagaggttggccctttctctaatgccttctggaaggcggaaaatgtgggaactataaatcactaggcggttgccttgttttgacttgagacacccaagaggaacagtcatgtttctcataaaaatcagtgggatcatttttgaattccatcagcctttgtatgtgagtgcaaaacattttaacagttttctcaaatcaacaaacagccttctcctatagctgtacttgcccccctccccaaaaaaccatggatgagaaagaaaggagtcaggggcctgataaaaaatacagacttaatgagcaactcaagatgagaaaactgctctttttccaaaaattaccaactgctgattacagctgaaatggaaccaaatgtttgttttctgatttttttttaatagctgtttaacaaattagtctttgctgagtaaaaggggaaatttctaaacctagtgcactgtttggccagtgtccacagcctcttttctggctgtgttttagagaaagggatttgagctataggctcgcctcctgttctcattctcacaaagctgccttgactgtggcctgcaaccacgagtgccatgctttcaggtcttctgtggcctactggccttcaagacagaggcctgccccagtgtgccacagatccatgtggatggagcctccttcagaggggtcacaggtctttgagactcagcctgggctttaatgtgtaggaaaagccttctggccacccagagagccggagccctgcttgctgtattctctgctcccttcttcctgctgggttttagccataatagggcccggtacgatttgggagtgacatttctgtaaagaagaggaaaaatcatttttctataatttgtaaagttgtgaaagagccactaccacagtttttacattgattattggaacatttcagaataaataaagatattttcttaatga

SEQ ID NO: 10239 - DNA, 2694 bp, Homo sapiens
agtgggctctgcccgccgtcccccgggggctgcttcccgccccaggcctccgcggaggacacgtgtcagcacgttcccgcggttgtcattccattgtcatagcccttcccctaggccgggaacccctcccccccaccagccccagttcttttatccctgggcccaacctccccgccgacccgcggtccaggcctcggtctctctcttcggcggcgagccgcggcccagaccccggcagaggacacttgtcggcacgttctcacccctgtcatctcagccccctgcctagctccaccccaggcttgggaacccggcccctgacggcccattgtccgcgggcccagcccccgcgctgaacgcacgctcgcccttgcccctaaccagcgcgtctaccccggcaacgcgcagtgacctgggatgcagccctcaggctgggcggccgccagggaggcggcgggccgcgacatgctggccgccgacctccggtgcagcctcttcgcctcggccctgcagagctacaagcgcgactcggtgctgcggcccttccccgcgtcctacgcccgcggcgactgtaaggactttgaagccctgcttgcagatgccagcaagttacctaacctgaaagaacttctccagtcctccggagacaaccacaaacgggcctgggacctggtgagctggattttatcctcaaaggtcctgacaatccacagtgcagggaaggcagagtttgaaaagatccaaaagctgactggggctcctcacacgcctgttcctgcaccggacttcctgtttgaaattgagtactttgacccagccaacgccaaattttatgagaccaaaggagaacgagacctaatctatgcatttcatggtagccgcctagaaaacttccattccattatccacaatggcctgcactgccatctgaacaagacatccttgttcggagaggggacctacctcaccagtgacttgagcctggccctcatatacagcccccatggccatgggtggcagcacagcctcctcggccccatccttagctgtgtggccgtgtgtgaggtcattgaccatccggacgtcaagtgccaaaccaagaagaaggattccaaggagatagatcgcagacgagcgagaatcaaacatagtgaagggggagacatccctcccaagtacttcgtggtcaccaataaccagctgctgcgagtgaagtacctcctggtgtattcacagaagccacccaagagggcttcgagccagctctcctggttttccagccattggtttaccgtcatgatatccctgtatctgctgctgctgctcatagtgagtgtcatcaactcctctgctttccaacacttttggaatcgtgcgaaaagataatctttctgggcctggtgtgggggctacctcaactatgtgccttatggtaacttgttctgtacctcctatgcctcatgtccagccaggttgagcctaggggccagttgggggaccacaggacaattttcatatggcctaaatgtatccattgcctttgatgatgttcccagccatactccagtcaacggggactactagtccctcactcttaggttttaggggagtccttccatctgctccttcttaaactgtcctagggagttggcttttcagccagggccaaaggaaaaagccctgctgcatttaaaaacaaagtgtccaagctgtcagtggtgtgtttacaatctctcctggcagaggttggccctttctctaatgccttctggaaggcggaaaatgtgggaactataaatcactaggcggttgccttgttttgacttgagacacccaagaggaacagtcatgtttctcataaaaatcagtgggatcatttttgaattccatcagcctttgtatgtgagtgcaaaacattttaacagttttctcaaatcaacaaacagccttctcctatagctgtacttgcccccctccccaaaaaaccatggatgagaaagaaaggagtcaggggcctgataaaaaatacagacttaatgagcaactcaagatgagaaaactgctctttttccaaaaattaccaactgctgattacagctgaaatggaaccaaatgtttgttttctgatttttttttaatagctgtttaacaaattagtctttgctgagtaaaaggggaaatttctaaacctagtgcactgtttggccagtgtccacagcctcttttctggctgtgttttagagaaagggatttgagctataggctcgcctcctgttctcattctcacaaagctgccttgactgtggcctgcaaccacgagtgccatgctttcaggtcttctgtggcctactggccttcaagacagaggcctgccccagtgtgccacagatccatgtggatggagcctccttcagaggggtcacaggtctttgagactcagcctgggctttaatgtgtaggaaaagccttctggccacccagagagccggagccctgcttgctgtattctctgctcccttcttcctgctgggttttagccataatagggcccggtacgatttgggagtgacatttctgtaaagaagaggaaaaatcatttttctataatttgtaaagttgtgaaagagccactaccacagtttttacattgattattggaacatttcagaataaataaagatattttcttaatga

SEQ ID NO: 10240 - DNA, 2737 bp, Homo sapiens
agtgggctctgcccgccgtcccccgggggctgcttcccgccccaggcctccgcggaggacacgtgtcagcacgttcccgcggttgtcattccattgtcatagcccttcccctaggccgggaacccctcccccccaccagccccagttcttttatccctgggcccaacctccccgccgacccgcggtccaggcctcggtctctctcttcggcggcgagccgcggcccagaccccggcagaggacacttgtcggcacgttctcacccctgtcatctcagccccctgcctagctccaccccaggcttgggaacccggcccctgacggcccattgtccgcgggcccagcccccgcgctgaacgcacgctcgcccttgcccctaaccagcgcgtctaccccggcaacgcgcagtgacctgggatgcagccctcaggctgggcggccgccagggaggcggcgggccgcgacatgctggccgccgacctccggtgcagcctcttcgcctcggccctgcagagctacaagcgcgactcggtgctgcggcccttccccgcgtcctacgcccgcggcgactgtaaggactttgaagccctgcttgcagatgccagcaagttacctaacctgaaagaacttctccagtcctccggagacaaccacaaacgggcctgggacctggtgagctggattttatcctcaaaggtcctgacaatccacagtgcagggaaggcagagtttgaaaagatccaaaagctgactggggctcctcacacgcctgttcctgcaccggacttcctgtttgaaattgagtactttgacccagccaacgccaaattttatgagaccaaaggagaacgagacctaatctatgcatttcatggtagccgcctagaaaacttccattccattatccacaatggcctgcactgccatctgaacaagacatccttgttcggagaggggacctacctcaccagtgacttgagcctggccctcatatacagcccccatggccatgggtggcagcacagcctcctcggccccatccttagctgtgtggccgtgtgtgaggtcattgaccatccggacgtcaagtgccaaaccaagaagaaggattccaaggagatagatcgcagacgagcgagaatcaaacatagtgaagggggagacatccctcccaagtacttcgtggtcaccaataaccagctgctgcgagtgaagtacctcctggtgtattcacagaagccacccaagagggcttcgagccagctctcctggttttccagccattggtttaccgtcatgatatccctgtatctgctgctgctgctcatagtgagtgtcatcaactcctctgctttccaacacttttggaatcgtgcgaaaagataatctttctgggcctggtgtgggggctacctcaactatgtgccttatggtaacttgttctgtacctcctatgcctcatgtccagccaggttgagcctaggggccagttgggggaccacaggacaattttcatatggcctaaatgtatccattgcctttgatgatgttcccagccatactccagtcaacggggactactagtccctcactcttaggttttaggggagtccttccatctgctccttcttaaactgtcctagggagttggcttttcagccagggccaaaggaaaaagccctgctgcatttaaaaacaaagtgtccaagctgtcagtggtgtgtttacaatctctcctggcagaggttggccctttctctaatgccttctggaaggcggaaaatgtgggaactataaatcactaggcggttgccttgttttgacttgagacacccaagaggaacagtcatgtttctcataaaaatcagtgggatcatttttgaattccatcagcctttgtatgtgagtgcaaaacattttaacagttttctcaaatcaacaaacagccttctcctatagctgtacttgcccccctccccaaaaaaccatggatgagaaagaaaggagtcaggggcctgataaaaaatacagacttaatgagcaactcaagatgagaaaactgctctttttccaaaaattaccaactgctgattacagctgaaatggaaccaaatgtttgttttctgatttttttttaatagctgtttaacaaattagtctttgctgagtaaaaggggaaatttctaaacctagtgcactgtttggccagtgtccacagcctcttttctggctgtgttttagagaaagggatttgagctataggctcgcctcctgttctcattctcacaaagctgccttgactgtggcctgcaaccacgagtgccatgctttcaggtcttctgtggcctactggccttcaagacagaggcctgccccagtgtgccacagatccatgtggatggagcctccttcagaggggtcacaggtctttgagactcagcctgggctttaatgtgtaggaaaagccttctggccacccagagagccggagccctgcttgctgtattctctgctcccttcttcctgctgggttttagccataatagggcccggtacgatttgggagtgacatttctgtaaagaagaggaaaaatcatttttctataatttgtaaagttgtgaaagagccactaccacagtttttacattgattattggaacatttcagaataaataaagatattttcttaatgaacaacaacacagaaaaacaacaagacagaaaacccattaaaag

SEQ ID NO: 10241 - DNA, 2160 bp, Homo sapiens
agtgggctctgcccgccgtcccccgggggctgcttcccgccccaggcctccgcggaggacacgtgtcagcacgttcccgcggttgtcattccattgtcatagcccttcccctaggccgggaacccctcccccccaccagccccagttcttttatccctgggcccaacctccccgccgacccgcggtccaggcctcggtctctctcttcggcggcgagccgcggcccagaccccggcagaggacacttgtcggcacgttctcacccctgtcatctcagccccctgcctagctccaccccaggcttgggaacccggcccctgacggcccattgtccgcgggcccagcccccgcgctgaacgcacgctcgcccttgcccctaaccagcgcgtctaccccggcaacgcgcagtgacctgggatgcagccctcaggctgggcggccgccagggaggcggcgggccgcgacatgctggccgccgacctccggtgcagcctcttcgcctcggccctgcagagctacaagcgcgactcggtgctgcggcccttccccgcgtcctacgcccgcggcgactgtaaggactttgaagccctgcttgcagatgccagcaagttacctaacctgaaagaacttctccagtcctccggagacaaccacaaacgggcctgggacctggtgagctggattttatcctcaaaggtcctgacaatccacagtgcagggaaggcagagtttgaaaagatccaaaagctgactggggctcctcacacgcctgttcctgcaccggacttcctgtttgaaattgagtactttgacccagccaacgccaaattttatgagaccaaaggagaacgagacctaatctatgcatttcatggtagccgcctagaaaacttccattccattatccacaatggcctgcactgccatctgaacaagacatccttgttcggagaggggacctacctcaccagtgacttgagcctggccctcatatacagcccccatggccatgggtggcagcacagcctcctcggccccatccttagctgtgtggccgtgtgtgaggtcattgaccatccggacgtcaagtgccaaaccaagaagaaggattccaaggagatagatcgcagacgagcgagaatcaaacatagtgaagggggagacatccctcccaagtacttcgtggtcaccaataaccagctgctgcgagtgaagtacctcctggtgtattcacagaagccacccaagagggcttcgagccagctctcctggttttccagccattggtttaccgtcatgatatccctgtatctgctgctgctgctcatagtgagtgtcatcaactcctctgctttccaacacttttggaatcgtgcgaaaagataatctttctgggcctggtgtgggggctacctcaactatgtgccttatggtaacttgttctgtacctcctatgcctcatgtccagccaggttgagcctaggggccagttgggggaccacaggacaattttcatatggcctaaatgtatccattgcctttgatgatgttcccagccatactccagtcaacggggactactagtccctcactcttaggttttaggggagtccttccatctgctccttcttaaactgtcctagggagttggcttttcagccagggccaaaggaaaaagccctgctgcatttaaaaacaaagtgtccaagctgtcagtggtgtgtttacaatctctcctggcagaggttggccctttctctaatgccttctggaaggcggaaaatgtgggaactataaatcactaggcggttgccttgttttgacttgagacacccaagaggaacagtcatgtttctcataaaaatcagtgggatcatttttgaattccatcagcctttgtatgtgagtgcaaaacattttaacagttttctcaaatcaacaaacagccccaggtttcttgagcaaggaagcacgaagcttcatttcatggctcaggcaaaggatgaaattcatcattttgtcttcttagagccagacttgttgtacacacttagaaaaatcatttttctataatttgtaaagttgtgaaagagccactaccacagtttttacattgattattggaacatttcagaataaataaagatattttcttaatga

SEQ ID NO: 10242 - DNA, 1448 bp, Homo sapiens
agtgggctctgcccgccgtcccccgggggctgcttcccgccccaggcctccgcggaggacacgtgtcagcacgttcccgcggttgtcattccattgtcatagcccttcccctaggccgggaacccctcccccccaccagccccagttcttttatccctgggcccaacctccccgccgacccgcggtccaggcctcggtctctctcttcggcggcgagccgcggcccagaccccggcagaggacacttgtcggcacgttctcacccctgtcatctcagccccctgcctagctccaccccaggcttgggaacccggcccctgacggcccattgtccgcgggcccagcccccgcgctgaacgcacgctcgcccttgcccctaaccagcgcgtctaccccggcaacgcgcagtgacctgggatgcagccctcaggctgggcggccgccagggaggcggcgggccgcgacatgctggccgccgacctccggtgcagcctcttcgcctcggccctgcagagctacaagcgcgactcggtgctgcggcccttccccgcgtcctacgcccgcggcgactgtaaggactttgaagccctgcttgcagatgccagcaagttacctaacctgaaagaacttctccagtcctccggagacaaccacaaacgggcctgggacctggtgagctggattttatcctcaaaggtcctgacaatccacagtgcagggaaggcagagtttgaaaagatccaaaagctgactggggctcctcacacgcctgttcctgcaccggacttcctgtttgaaattgagtactttgacccagccaacgccaaattttatgagaccaaaggagaacgagacctaatctatgcatttcatggtagccgcctagaaaacttccattccattatccacaatggcctgcactgccatctgaacaagacatccttgttcggagaggggacctacctcaccagtgacttgagcctggccctcatatacagcccccatggccatgggtggcagcacagcctcctcggccccatccttagctgtgtggccgtgtgtgaggtcattgaccatccggacgtcaagtgccaaaccaagaagaaggattccaaggagatagatcgcagacgagcgagaatcaaacatagtgaagggggagacatccctcccaagtacttcgtggtcaccaataaccagctgctgcgagtgaagtacctcctggtgtattcacagaagccacccaagagggcttcgagccagctctcctggttttccagccattggtttaccgtcatgatatccctgtatctgctgctgctgctcatagacccacctgccatgctgtgaggacacccaggccacatagagagagtgaggccacatgtaggttttacagccagaagccccactgaaaaccaaacctgcaaccagcatcaactgccaaa

SEQ ID NO: 10243 - DNA, 465 bp, Homo sapiens
agcttggatttatatctgcatgtgtctaaaagtgaaaagacttcagctaaattacctgccacctgccaccatctgggcagacaccctgagctaggtcattgttatagataccaagatgggttgtaaatggtaaaagaggagctacaaaagggaagatcaggatgagctcattgcatagctgtctttgcgcatttagaaaatatcctgttgaaaggcgtgtcagtgcctgggcaaacagccccaggtttcttgagcaaggaagcacgaagcttcatttcatggctcaggcaaaggatgaaattcatcattttgtcttcttagagccagacttgttgtacacacttaaaaaaaatgtttttctctttttgccaacaccactcttttttccctcttaagcagggcttcgagccagctctcctggttttccagccattggtttaccgtcatgatatccctgtatctgct

SEQ ID NO: 10244 - DNA, 449 bp, Homo sapiens
cggccgccagggaggcggcgggccgcgacatgctggccgccgacctccggtgcagcctcttcgcctcggccctgcagagctacaagcgcgactcggtgctgcggcccttccccgcgtcctacgcccgcggcgactgtaaggactttgaagccctggtgagtgtgctttgtcctggcgctgcccactgcgtcctggaccaagtgccctgtggaaccacaggtagaggcagttccatccgcattagtaaacatgacagccgccagactttccattcccagcttggtcttgccttgccttggggaaggtttccatgagctaagaacactgctaacaccctcatgtcaacgctcactcccaaggcacttggtggctgcttctctcctgtcaatgacaaatgactccgaggactgaagtgaggaatagttgcatagtcctccacagattttcta

SEQ ID NO: 10245 - DNA, 345 bp, Homo sapiens
ctggccttcaagacagaggcctgccccagtgtgccacagatccatgtggatggagcctccttcagaggggtcacaggtctttgagactcagcctgggctttaatgtgtaggaaaagccttctggccacccagagagccggagccctgcttgctgtattctctgctcccttcttcctgctgggttttagccataatagggcccggtacgatttgggagtgacatttctgtaaagaagaggaaaaatcatttttctataatttgtaaagttgtgaaagagccactaccacagtttttacattgattattggaacatttcagaataaataaagatattttcttaatga

SEQ ID NO: 10246 - DNA, 391 bp, Homo sapiens
agacattagatctagtatttcaatgaagacaaatcttttgattctaacataaaccagatacattgtttttaggtgattccaattttgatgtttccaaaacatgagctaaatcatggcagtcactagtgctatttaccaaatatttctagtttctccatttccagaaacatgtcaagatttgtgcttctctgcccttttaggtgaaaccatgtggcattctgtggccaacagaaggcgatcatcagtaatacgtggagctaccaggtggaagcttcaaagccagtgtacattttgccataacatttatcaaagatgcttaacaagtttcttagctatgacacctaaaacataagcaaccaaattaaaaatacattggacttcataaaaatta

SEQ ID NO: 10247 - DNA, 501 bp, Homo sapiens
aactgtgcctgaacctgaggtgcccaaccccaaataaacccaagatgctgtgtattttcagaggacctggtctggctgtgtgagcctcgggagggactgggggagcaagggggccgtctgggaggcaggctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctactccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 10248 - DNA, 4481 bp, Homo sapiens
ccgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcgggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgagggctgtgccacagcccggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggaggacgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgactttgacactgaggctggagctgtgtcctcctcagagcccactgtggccagagatgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctactccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 10249 - DNA, 4685 bp, Homo sapiens
ttcactttccagctgccactcagcaactgccatacagcaaaaggagggattgcaactaccatgcagcaactgccaccttgaaagagaaggggttgaagagtagtctctaatatccagcaccagttggccttaggttccctgcctccagaccttattctcctgcaacatcaccactggttgaaaccttactacaaatcaagctgtgaagtcactggagccctgtagcaagtcatgtccctgtaacgatgagtgagctgacagctaaggggcttgcctaaaccacacagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcgggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgagggctgtgccacagcccggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggaggacgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgactttgacactgaggctggagctgtgtcctcctcagagcccactgtggccagagatgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctactccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 10250 - DNA, 4113 bp, Homo sapiens
ccgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcgggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgagggctgtgccacagcccggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggaggacgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgactttgacactgaggctggagctgtgtcctcctcagagcccactgtggccagagatgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctactccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 10251 - DNA, 4183 bp, Homo sapiens
ccgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcgggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgagggctgtgccacagcccggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggaggacgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgaccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgactttgacactgaggctggagctgtgtcctcctcagagcccactgtggccagagatgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctactccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 10252 - DNA, 4429 bp, Homo sapiens
ccgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcgggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgagggctgtgccacagcccggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggaggacgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgactttgacactgaggctggagctgtgtcctcctcagagcccactgtggccagagatgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctactccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 10253 - DNA, 1870 bp, Homo sapiens
ccagctgttaccgccccggagttacaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgactttgacactgaggctggagctgtgtcctcctcagagcccactgtggccagagatgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctactccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 10254 - DNA, 3861 bp, Homo sapiens
ccgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcgggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgagggctgtgccacagcccggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggaggacgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgactttgacactgaggctggagctgtgtcctcctcagagcccactgtggccagagatgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatcacaataaagtccccatttgattttta

SEQ ID NO: 10255 - DNA, 1777 bp, Homo sapiens
tgatggctgtcttatatatggcagggtcctctgttcccatgcctcagttttccatctgagcaatgggtattggaccaggccaatggttcctgacctgctgagcccctttgctctcatccttgtacccaaacagcctctcctgagtggtgccctcatcagatagagttctggtgtcacctggggagaagcacatcttttttgcttggatggtctggccagtgggcatgtgtggggaagagttgtgatgccagcctgacttggggcagagcagaagcactgtttggatggctttggaagccaggaggtgggacctgagggtatggggtctgcaggctgactatgtgttcgttttccaggtgactttgacactgaggctggagctgtgtcctcctcagagcccactgtggccagagatgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgcccagctgccccggggccacgagtggatgctggggctgtggctgctcccctggaggggttccatctctgaccctgtggcccattcagggtgggctgaagagcccctgagcttttaacgtgagggtctttattggataggactactccctatttcttgcctagagaacacacatgggctttggagcccgacagacctgggcttgaatcccggctcgtgttcttgctgcaggacctgggcaagaaacttcacctctgctgagccctcattccccatgtgtaaaatgggacaacgcaacctacctcacagggttgttgtggggatgctgcctgatacataccctgtcaccatttggtctctgcttcctctctgggacagggcctagaattggaggcagagaaccttcctatagaaagtcttcgtgtgtcctaggacttggctatcgtagagtggtaccttaggcagtggatgtgactcacactttcaggagtcaccccccagcatttggggttgggttggccctactccagcctggagctccctgagggagcctgcactccctgctcccaatccccgctactggtgcagggatgcagcctggagctggcgtccttgttctgggcctgctgctgccgccaccccaggaggccccaggcctgtcctgaattgacatcagtgcttccctgaactgcctcccccacccctggcattatcccaggaaacttatgttttctagaagctaagcagctgctgggactcagggactggtgcaggtaggctgagtggcagctcagtcctagaaggtctctgaagatctggactgaggaccctgctactccccaagccagagcccatcagccaggcctgctgtgagccacctgcctgtggagtgctgagctcaaccaaaggctggcaagctctgggcctcatttaagggattctgatgagccgatgggccctggaggcagcccattaaagcatctggctcgtttttggaa

SEQ ID NO: 10256 - DNA, 3862 bp, Homo sapiens
ccgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcgggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgagggctgtgccacagcccggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggaggacgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgtgtgtgctgtgtgagtgcgtcacagctggggctgagtgattccaaggactcctgcccgggtagggggctttaggatgagctctaggtacccccaccccttgaccctccagacaatcagtgagcaccttcatagcctcttttgtaggcttctgaacatgccagctgctctgtccccatggaaactcctcggcctcccctggtgctgcaccttcttggattccctcctcctctgcctgtgccttctccatctttggtgcagtgtttccggcactctggttaggccctgttttctagctgagataatttccctgatctccagcctagcatcccctttgtgagctctagccctaaataacccactgcatgctgggcctcagcccctgggtctctctcccacactgaactcatcccaaatcacactcccgagccttcccctcagctcacttcccacaaccagttcttttccatgtcagtgaagggcaccccctttcacaaagctcctcatgctctagacctggtgagggccacagctgcctttttgaacgtgtagttttgcagtcctccccggcccttgcatacacagaagtgtgcgcataagtcgcattgttttgtggtttgcttttcctctactaaatgatgtgcctgctgttctccagcttgttttcttttaatgtcctggaggaccacacaactgccgaagtgttgtgtggcgtgtatgatcacacttcttcagctagggatctggtgatgggaccaagtggattctgttattgcccctcctgcgtcagtacacctggca

SEQ ID NO: 10257 - DNA, 3616 bp, Homo sapiens
ccgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcgggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgagggctgtgccacagcccggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggaggacgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagctctgtggccttcatgttccgaaagttcaagatcctccgtccggcacctttgcctgcagccgtggtcccgtccacgcccacctcagctcctgctcccacacagcctgcacccacccccacatctgggcccattggactgcggattctcgctcaacagcccttgtctgtgacctgcttcagcctggcactgcccagccctccagccgtagctgtggcctcccctgcccctgctccagctccatcccctgctccggctcgagctcaggctccagcttcagcccgggatccagctccagctccagctccagttgcaggccctgctccagcatctacttcagccccaggggactccctggagcagcattttacaggactacatgcgtccctgtgtgatgctatttctggctccgtcgcccactctcctccagagaagcttcgcgagtggctagagacggctgggccctggggccaggctgcgtggcaggactgccagggtgtgcaggggctgctggccaagctgctgtctcagctgcagcgcttcgatcgcacccaccggtgccccttcccccatgtggtgcgagctggcgccatcttcgtgcccattcacctggtgaaggagcggctcttccctcggctgccacccgcttctgtggaccatgtgctgcaggagcatcgtgtggagctgcggcccaccacgctgtcggaggagcgggcactgcgggagctcgccctgccaggctgcacctcacgcatgctgaagttactggcgctgcgccagctgccggacatttaccccgaccttctcggcctgcagtggcgcgactgtgtacgccgccagctgggtgagcatggggcagccccagtggccaccggagctgtgtgagcaagtgacaggtgactttgacactgaggctggagctgtgtcctcctcagagcccactgtggccagagatgagccagagagcctagccctggctcagaagtcaccggcccccaaggtcaggaagccaggcaggaagccaccaacccctggcccggagaaagcagaggcagctgctggggaagagtcctgtggtgcctcccctacccctgctaccagtgccagcccacctggccccacactgaaggcccgcttccgcagtctgctggagaccgcctggctcaatggcctggctctgcccacctggggccacaagtcctcaagaccagaccagccctcaccctgcccacagctgctggacagccagagccatcacctgtagcactggttgccagtgctgtgtgtatagcagtcactctccacccttcccttctgcctgtcatggctggctgagggtcagaggaagggccaggcggcctgagggtcacaggacatggacaggcggggtgagggtcacaggaagggccaggcgggctgagggtcagaggaagggacaggtgggcctctgct

SEQ ID NO: 10258 - DNA, 2436 bp, Homo sapiens
ccgcagacggcgcccagcggcggcgcgaacggcagctaggagggttgctccgggcttggtgctcactgcgacttcccgcgcagggcccggtcggactaggacccgcggcctgagagacgctggaggatgcggacgcggaggccgcctggggtagcggcggcgggagtcctggcgctctgcaggtcagaagttgagtagcaggggcctaggagggctcgaagccttcacagcgatggcagagaagcgacccctgagaaccctggggcctgtgatgtatggcaagctgccccgcttagagacagactccgggctcgagcacagcctgccccactctgttggtaaccaggatccctgcacctacaaggggtcctacttctcctgccccatggcgggtactcctaaggccgagtctgagcagttggcgtcctggaccccatacccacccttgtactctaccggtatggcaggacccccacttcaggcagacaacctgctgaccaactgcctgttctaccgctcgccagcagaaggccctgagaagatgcaggactccagccctgttgagctcctgcccttcagtccccaggctcactcctacccaggcccaccactggcagcacccaaacctgtctaccgcaaccctctgtgctatgggctctcaacttgtctgggggaaggagcagtgaagaggccactggatgttgactggactctggcgactgggcccctgttgccctcagctgacccaccctgctctctggccccagctcctagcaagggccagactctggatggcaccttcttgcggggggtgccagctgaggggtccagtaaagactcctcagggagcttctccccatgccagcccttcctggagaaatatcagaccatccacagcacgggcttcctggcctccaggtacacaggtccttaccctaggaactccaagcaagcaatgtctgaggggccctcaagtccttggacccagctggcccagcccctggggccaccctgtcaggacaccgggcccacccactacccaccaccccaccacccaccaccccaccctccacaggccctgccttgccctccagcctgtcgccacccagagaagcagggcagctacagcccagcactcccactgcagcctctggggggccacaaggggaccgggtaccaggctggtgggctgggcagcccctacctgaggcagcaggcagcccaggcaccttacattcccccactggggctggacgcttacccctacccctctgcccctctcccagcaccctctccaggcctcaagctggagccgcctctcactccacggtgcccattggactttgccccccagacactgagttttccttatgcccgggatgacctctctctctatggagcatcccctgggcttggagggacaccaccttcccagaacaatgtgagggctgtgccacagcccggtgccttccagagggcatgccagcctttgccagcgagccagccctgctcagagcctgtgaggcctgcacaggaagccgaagagaagacctggctgcccagctgcaggaaagagaagctccagccccggctcagtgagcactctgggccgcccatcgtcatccgagacagtccagttccctgtacccccccagcactgcccccctgtgcccgggagtgccagtctcttccacagaaggaggacgcaaggccacccagctctccaccaatgcctgtcattgacaatgtcttcagcctggccccctaccgtgactatctggatgtgccggcacccgaggccacaactgagcctgactctgccacagctgagcctgactcagccccagccaccagtgaaggtcaggacaaaggctgcagggggaccctgcctgcccaggagggcccctcagggagtaaacccctaaggggctcacttaaggaggaggtagccctggatttgagtgtgaggaagcccacagcagaggcctcccctgtcaaggcttcccgttctgtggagcatgccaagcctactgcagccatggatgtgccagatgtgggcaacatggtgtcagatctgccaggcctgaaaaagatagacacagaagcaccaggcttgcctggggtgccagtgaccacagatgccatgccaaggaccaacttccacagcttgcctttttgaacgtgtagttttgcagtcctccccggcccttgcatacacagaagtgtgcgcataagtcgcattgttttgtggtttgcttttcctctactaaatgatgtgcctgctgttctccagcttgttttcttttaatgtcctggaggaccacacaactgccgaagtgttgtgtggcgtgtatgatcacacttcttcagctagggatctggtgatgggaccaagtggattctgttattgcccctcctgcgtcagtacacctggca

SEQ ID NO: 10259 - DNA, 275 bp, Homo sapiens
ggtggtgcgtgcttgtaatcccagatactcaggaggctgaggcaggagaatcgtttgaacccagaaagtggaatttggagtgaatgaagatcacgccactgcactccagcctggacaacaagagcgaaactccatctcaaaaaaaaagagtagatttaactggggaacaatcaagtcatgtagctaagtaacccactacatgtggtaagaaggacataaaatagataatagtagattctttgagaatgaggctacaattcagttatttggttaaa

SEQ ID NO: 10260 - DNA, 421 bp, Homo sapiens
tgtcatgaagaagaccacattagcacatcatgccactcttactattttagggactccacccagtgaagtcagtgatgtgctgttcttgcttccctagcttgaagaagagtatcagacttaatattacattcatacagtggctctatgatttgggtgataaataattgaatctgctttgctaatgtgagaaatagattattcagggtcactcaagccagggttccacttttcaaagttctaggtggtaagctagatcattaggaacccacttatttgtttacaaaatggaaattttcagtctttgtgagaatttgtcagcataacaatttgccaacagagactgttgattcagaggtgtctgtggcatgatagaattcacagcagcacagttttaaataaagttacacctttcagaaagcgc

SEQ ID NO: 10261 - DNA, 368 bp, Homo sapiens
aattgaggacaagagatgtatggtctttgctcaatgtcacttagctaattggtataataaatgcaagagaagaaacattacaagacaaatgtgacttaactgccagaggatgataaaacctacacttgtgggccggaaaggactttaaacggatttcagctgacttatgaaccaacagacaatgtgaggaacattcactgaagagctgatttgttaaagtggtctcaagaatattaattgaggtggatggtaggcagatagttaagaacatttaaaatttccaaccaagaaatatatatttgattctgtggaacatgggagatatctaaagtttagagaacatttcttaagaatgccctgctacctca

SEQ ID NO: 10262 - DNA, 205 bp, Homo sapiens
tcctgaattcctttccctggacagaagtgaccctgtgtgaccttcagctgcagagcagccccctccacacatctgagttgaccctgaacgccccgtgggcagggctcggattcagccttgatgcccaaagcaacaatgccagtgcagcgcccctgcagccgggcacccccctcgtcttccctcgttcctgatcctgtctggctgg

SEQ ID NO: 10263 - DNA, 410 bp, Homo sapiens
gagactttgtctaaccttttgggaaagagaaactctactggggttcctaagctataaagatgacatacgtccaaagctgctgggagtagaatgtgaagaccaatgattcctaccatcatttgagctggattcaaccgaccttgaagttagcaccatacagattttcttgccatataaaccagcaatttaatttcagtcttcccccatccctggaaagggagtatcttaaaccagttcagtttggttttctgtcattactaatgtggttgctattggtggtaatgaaacctggtaggaacaaccacatatcaatgggaacataaaacgtctagcatcttaaagtgccattcaaccttgagattctattattttatgctttctctctagaaataagtaaatccaatattaac

SEQ ID NO: 10264 - DNA, 448 bp, Homo sapiens
tacatcattggaatctccattaagaaatattattctgacctagttctctgtgtcatgctgcagattgtccttctcttgactcatggaatgctttgtgagaaagaactacaaagccgggtccctcgatattagccatctcacccttcaaagttcagccaggagtgggacaaaaccctcgtcaccatgttgacatgtttacttctggcgcaggaaaatactgctgttgcccaatttggtttcccagtccattcacttgcctggagacatatattttatgctttcctttgatgatttacaaataaattaacgtgattcactaaggtctgccagcatatatgcgttactggagaaatctgagatgttgaaaaagtattttaatttattgtatcccaatactttcttaagaaagtttcttaagaaccaaataaatatcatcagctagtttata

SEQ ID NO: 10265 - DNA, 2191 bp, Homo sapiens
tgaaccagtgtggggactgggaagaaaagcactttgagcaaggactcttgggttcgagcaaaggcaattagttgacatgatacttcttaagttcctcagtatgtatatgttacaatcgtttatcagacatcttaatagaatcctaattgaaaaaccagttgccaaaattgcacaagttctgctcgctgatactagctttctccccttaactctaaaataccagggatgcttaaggacgtttgtaatagtttttttaatgctttgtttcacttttttaaaaaagaatctttgaagggaaggaagagcagaaagaagtattttaagaaaaatggagagaagtagatagtattgaaagtatatttcttgaagagagagtatctaagtgctataccaagattttatagggcttcctgttgccaaatgtgatgttgagataatgcacagctaagatggcaaatccatcaattattaactggctctgccacttctgtcatggaatgcaaggattgagaggtgactctggggagaccctgggtgtgtgagagagctccattcatctggccctggatatgtttttcaaacagagagggagaaagcgccagtccctgcaaggtgaactgacctggcactgtttcagtgggagcctcactgcctgccttttccatgctaggagacaaagcatcctctaccccatctgtgaatcggtgctgtggccactgcgagaagcatgattcatgaggtatgatgctcttgagctcccagacaatgtgctgagttaataggttcacttgagatgtatacaccaaggctgtttctttttttaaatctagtccccaatttggagtatttttgcatgtttttgtacagagtaatccattcctctcattgtgtatcttaatctcctctgacttttccattgtctttctcaatcccaccctttgctcttcggatctcaccaaccccccttaaaaaataaatcatgtttgagcaagaaggtagaacacgccctccctcatcttggttttaattgctttggaaacgtgttctaccctgtccagggtttgcataacgtgaattaagtgaatgagatgttctagtattatatcttaacctgataagactatctaagatttctagtatatggtgcatttgctttcctgtgcaaactttggttcagctgccctgcagagaatctcaccattttcctgccagtgccagtataaagaatgcaggagagctaaacctgggtacatgaaggtcagaggggtgaggacggtcgagaaatggggagaagacttgggcttgagacgacctgggcttttcatgtgtagctcactcagcagtatgaggatgactgacacaccagtgggtggtttccaagtgaggcaaatgcccatttcccctctcccctcacaccttgcctggcttcttccatgaagtccttgctgcttttctgcctccccaaaggtgaggggaaggggctggttggggatctgggaaagccagttctctgttctctcctgctggtgatggactaggccttttagaactagcaagatccctcacacagctgggagaacacacacctttcttactccagacccattggtgtgtctccagtaacaaaattattggactcagcctccatatttgacagcaaaagtggccagagggagttgaaatatcttgaagaaaaggaattttcactaagatatgtcctctccctctcccagagtttagctgtttattccttttttttgtttatattgttctcatctgcataaaaccagtctcttgcaataagcctgccgcagaatcaaagtctgtacttcaaaaggtaactgcaccaagggatgggacagtgtgcatcaccctgatctaatcattgtgacgttggtagcttcctaaatactgtatgtaccttgaacaagggttttatttttgttttgttctgttttgctttttgtttttattggtaggctaaggtaattaaattttttaatttgctgttactttggttgtattttctgtactataactgcctacagtatgtcttttgcataaaatgcataagggtttggggatgtaaatggaattttattcatattttgtccaaatacctcttgtaatttgtatcaaaattcttgtacaatttttatattaaagatttatcagtcactgaaaaatctta

SEQ ID NO: 10266 - DNA, 471 bp, Homo sapiens
agcggtagcagcggcagcggcagcttggtcctctgactctcttcggtgacgggtattcttgggtggataatacggattacgttgttattgcttaagaatacgcgtagtcgaggagagtaccagcggcaggggggcagcggccgccctccccagcccaccagctggccactaaacgcccgtggttgccaagcgaagaggaagccaccgccaccacacccctcaagcatgcctgggcactcctggggacaatcggacgtggcaggagttggcatgcccaagatgaagctgggaaggatgacccagagtggaaggcgtgggctggggctccaggtctcagctctcgccagcgtcggaccacacagctttgccagctttgcaccttgcctttccttcttgtgaggcatctgggaccgtcctatcaaggcgcttcaaaggtggaaggacagagtgctggggacaagaacgtaccag

SEQ ID NO: 10267 - DNA, 748 bp, Homo sapiens
gctgggattacaggcacgtgcaaccaagcccggctaatttttgtgtttttagtagagactaggtttcaacatgttaggctgatctcaaactcctgacctcgtgatctgcccgcctcggccttccaaagtgctggggttacagacttgagccactgcacctggccatggggttgtttcttaattagatatagctgaaaagaacgctagaccaaataggttctctgccttgccttttcgtttgttttgttttagctattatcagggaaccaaaaactttaaggagctagtactggtcttaatttttaataactagagatagcagagttagaaactaagttcaaagtgagagaacagctgcatttgtctttctgacctcatgcaattcctaggaaactctgtgttctgtgatttagtcaggcaataaaatgctctcactccttctctgtctctttatttcttccctaaatggaaaagaattgaccaggctgctttgagggataaagatcctgataacgcggctgggtgcggtggctcatgcctgtaatcccagcactttgggaggcgggcagatcacctgaggtcaggagttcaagaccagcctggccaatatggtgaaaccccatctctactaaaaaaaaaaaatgcaaaaattacctgggcgtggtggtgggtgcctgtaatcccagctactcaggaggctgaggcgagagaatcgcttgaacctgggaggtggaggttgcagtgaacc

SEQ ID NO: 10268 - DNA, 478 bp, Homo sapiens
atgactacagccagtgtaggtagaaggagacattctattcttgtattctgtgaaagtttgtttttcttttaaaattgttctaggtgtacctgcacggaatgttctaccaactcttcttccactcctttcccatgactaatgataggctgataattttttagcatcaccagggagcagaataagtgaagtctgttcagattttgaatcaggggatgaatggctcattaacagcctcagccaactctgttaacccccaggaactgatgtgctaagttcagccttacttttccatggcatctctgcttctggctttacatcagggtcctttcctactattctcttttaaccacacagaatccaaattcaatcccaaagttaattattaaatatgtccagtggcacaaatttcagaaaagtttgagtgcctgacaggatgcccaccctcttgcccctccctttctggcctggatgttatgca

SEQ ID NO: 10269 - DNA, 400 bp, Homo sapiens
attcctcattcagcaaacgtgccttaagatgtcagtgacatgccagatgctcataaggtccctgccttcttagagccgatgtttgttctagttggggaaacaaatggtgcacaagtcaacaaataagagaagcaccaattgcactgagtgttgtgaaggcaataagccagtgagccgagagaggccacttttgttttttatagggtggtcattagtgaagcaggaagtgcctggtacatggcagctctagtcagagtcatttccactgagcttcctactgggctgtctgtgaacttcaagcagaaggcttcattcctggtcaaccacagcccccgcagccccgtgtggctcagggagttagctgccatgctggatgttgttgaacgtgctgcacgatctt

SEQ ID NO: 10270 - DNA, 1370 bp, Homo sapiens
gcctcgtgccgggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacagacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgtcctcaaatggatttctgtgtggcagtggagtgattgcatgaatttttctgtaacacattaactttgtattattattaagggagtttgagaaagctttgcttataatgtcaaggcaaggaggtaaaaactggagcccaaagaaattcccttagggcaagattatgttataatagaaaattgaatttcctgaggcagtggctgccaccccttttcagatgtttagtcctgcaaatagcatctttcttgtagtctgtgacatggatggggatgctagggcccttaggggcaaggggactaaactaaatcaagttgagtttttttccagcaggggttaggggaggtactcgctgttgatatttgacactagaaagtaatcttttttacaaaactgtttttctaggtgggtggaaagtgaaactgccacatccttgttggtttagtccaagagatcatttgcaacaacagtagatgtccgggttttgtttctgtctttttattatgaaaaactatgttaagggggaaaatgtggattatggtaaccagaggaatccctagccttgttttccttagaagacttgtttagtgttttatcagacgtctgttgtagttgtagacaggaaagcttgtgagaaaaacaccacatggagcctgtaaatgtttttgcacaacctgtaaagcattcttggaagtggccagtaaaaaggggttttaccattta

SEQ ID NO: 10271 - DNA, 1517 bp, Homo sapiens
gcctcgtgccgggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacagacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgtcctcaaatggatttctgtgtggcagtggagtgattgcatgaatttttctgtaacacattaactttgtattattattaagggagtttgagaaagctttgcttataatgtcaaggcaaggaggtaaaaactggagcccaaagaaattcccttagggcaagattatgttataatagaaaattgaatttcctgaggcagtggctgccaccccttttcagatgtttagtcctgcaaatagcatctttcttgtagtctgtgacatggatggggatgctagggcccttaggggcaaggggactaaactaaatcaagttgagtttttttccagcaggggttaggggaggtactcgctgttgatatttgacactagaaagtaatcttttttacaaaactgtttttctaggtgggtggaaagtgaaactgccacatccttgttggtttagtccaagagatcatttgcaacaacagtagatgtccgggttttgtttctgtctttttattatgaaaaactatgttaagggggaaaatgtggattatggtaaccagaggaatccctagccttgttttccttagaagacttgtttagtgttttatcagacgtctgttgtagttgtagacaggaaagcttgtgagaaaaacaccacatggagcctgtaaatgtttttgcacaacctgtaaagcattcttggaagtggccagtaaaaaggggttttaccatttaaaaaaaaaatgtaactgtgtcattgtttacatctgtaactttttcctcccctgttctcattacaccattctggcgaaaatgtaggcaaagtagcttccagttttagaataaataaccatttggattgaattcaccctaaaaaaagtg

SEQ ID NO: 10272 - DNA, 577 bp, Homo sapiens
aaaagggccttcctagaaaaaaagacaaagactaccaaggatgtatgaagggaagaaagaagtgtgaggaactgtggcactaaggatggcctggtgagcaccaaatgatgtgtagctagaggaatgcaagaggagtgagagaactcagggccgcccacccctaatcagaccaccacccatggccacacaatgttcctttgttgtttcaattacagtgcatagaatttgttttaaaataacacttctgataccaaattttaaatatggtatcatctcaatggtgtaaataatgcattaaaaatgggctggcaggaaatatgccaacctggttactgcctctaggaagagcgggtaggaataatcatctttttgcttcttcattcttttccattttccagttttctgtaactatgtattatcaggggaaaaagcatacttttcaaaatgaatttcatattataggagaaataaagccagttatttcccccaaataatccctggccgaggaggaccctcgagtcaaataaacagatatataaaggattctctgttactgttaagactttctttgcccagc

SEQ ID NO: 10273 - DNA, 520 bp, Homo sapiens
ttttgagacaatctcactctgtcacccaggctggagtgcagtggtgcaatctcggctcactgcaacctccacctccccagttcaagcgattcttgggcctccgcctctggagtagctgggattactggcacacaccagcaccctcgactaaattttgtatgtatgtatgtatttatttattagatggggtttcgctcttgttgcccaggctgagggcaatggcttgatctctgctcacttcaacctccgcctcccaggtcaagcgattctcctgcctcagcctcccgagtagctgggattacagacacctgccaccatgccggcttattttttgtatttttagtagggatagggtttcatcatgttggccaagcaactctcaaactcctgacctcaggcaatccacccgcctcagcctcccaaagtgctgggattacaggtgtgagccactgcgcccagccacacaacctttttctaaatgtgacaatacagtgactgctttataaagctgcctttgaag

SEQ ID NO: 10274 - DNA, 257 bp, Homo sapiens
ttttctctttgtttttgccctgttcaggatttttgttttatttagacattttcagtgctttatatctcacattaccacttttctttcttagtttctttcaattattctttagtttttaattccagtactcagcattattactgaaaatatcttaacctcattcattttctttgtcacccatggtcctttagaagtttattactctcccaggcctctgctttcatcatagtgtataaaagagggctctttgtataatt

SEQ ID NO: 10275 - DNA, 601 bp, Homo sapiens
tgaactgtgcagctggaagcagtgttttccgagaggcagagtggcacgggtttctttggagttagtcagatcgaggtctgagtcttgactttttaactgactaccctgggttacctagggcaagttacctctctgagcctcagcttcctcctctttaaattcggttaaaatggaacctacctaactgcccaaaggaatcgcgattgtgatgcaggtaaaatgctaagcatagcatttggcatagtaagcataatgttaattgttgctgctgtcattatttcagaagacctggtgatcggatgcttccagatcaacaattgattgactccaggtaaatctctcagcctccctgagcctcagtatcctcatctgtaaaatagactactatggtgtggagtaatgagaagtaatctcattacatgtgagtttaattgtgtgttaagagtgctgctaatgcatgctgagcttaatacctaggtgatgggttgataggtgcaataaaccaccacggcatacatttacctacgtaacaaacctgcacattctgcacatgtaccccagaacttaaaataaaaataaaatttttttaaaaaaagagtga

SEQ ID NO: 10276 - DNA, 352 bp, Homo sapiens
tctgtgactctgggttgttgcatttaaagttatcctcattctctagccagagtttccctgtgtgagtccagaacatctcctgaatacaaagaagcagggtttgttactgtctattgcaaccgggagcctgtagtcatcacctcaaagttgcgagggctccatgcagtcccaatgctcttcaccagcgctccagcactgcccgttttcgtgaactatgcacatctaagcagtgtgcatattttatttggacacttgatatttttgtaacccctttttaaaaaaaaatcataaggagcccattagttttaaggcagtcacacaaaatgtattaaataccgaatgcaaagaaccc

SEQ ID NO: 10277 - DNA, 2528 bp, Homo sapiens
gccacgttggattagggcccaccctaatgactcattttaactagatgactctgtaaagactctccaggccatctccaaataagatgccattctgaggtactaagagttaagacctcaacgtgtctttctgggggatactattcaacccatagcacatcccctcatcccccatggaataaccgggtcagaggtggagcaggtaggactgaactagagaatgtgccccttggtgggtggccctttccctaattaaggcacctttctttgggctgagacttctctgcaaagaggggagggggaaaggatagttaaatttgtaagtttcatggcactccaagtcaggttctggggctttctgctcttcctttttctggttatcagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgaggtggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcattgt

SEQ ID NO: 10278 - DNA, 2109 bp, Homo sapiens
gcagggggacagttgttagtgttgcactctgaaagagctgttggttaattcctgccttcctcccttttcccagtccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgaggtggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcattgt

SEQ ID NO: 10279 - DNA, 1936 bp, Homo sapiens
gccactccccactttgctatgtgggggaaggaccgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcattgt

SEQ ID NO: 10280 - DNA, 2473 bp, Homo sapiens
gccactccccactttgctatgtgggggaaggaccgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatgaaatgatccagcctgtgtgcctgcccaactctgaagagaacttccccgatggaaaagtgtgctggacgtcaggatggggggccacagaggatggagcaggtgacgcctcccctgtcctgaaccacgcggccgtccctttgatttccaacaagatctgcaaccacagggacgtgtacggtggcatcatctccccctccatgctctgcgcgggctacctgacgggtggcgtggacagctgccagggggacagcggggggcccctggtgtgtcaagagaggaggctgtggaagttagtgggagcgaccagctttggcatcggctgcgcagaggtgaacaagcctggggtgtacacccgtgtcacctccttcctggactggatccacgagcagatggagagagacctaaaaacctgaagaggaaggggacaagtagccacctgagttcctgaggtgatgaagacagcccgatcctcccctggactcccgtgtaggaacctgcacacgagcagacacccttggagctctgagttccggcaccagtagcaggcccgaaagaggcacccttccatctgattccagcacaaccttcaagctgctttttgttttttgtttttttgaggtggagtctcgctctgttgcccaggctggagtgcagtggcgaaatccctgctcactgcagcctccgcttccctggttcaagcgattctcttgcctcagcttccccagtagctgggaccacaggtgcccgccaccacacccaactaatttttgtatttttagtagagacagggtttcaccatgttggccaggctgctctcaaacccctgacctcaaatgatgtgcctgcttcagcctcccacagtgctgggattacaggcatgggccaccacgcctagcctcacgctcctttctgatcttcactaagaacaaaagaagcagcaacttgcaagggcggcctttcccactggtccatctggttttctctccaggggtcttgcaaaattcctgacgagataagcagttatgtgacctcacgtgcaaagccaccaacagccactcagaaaagacgcaccagcccagaagtgcagaactgcagtcactgcacgttttcatctctagggaccagaaccaaacccaccctttctacttccaagacttattttcacatgtggggaggttaatctaggaatgactcgtttaaggcctattttcatgatttctttgtagcatttggtgcttgacgtattattgtcctttgattccaaataatatgtttccttccctcattgt

SEQ ID NO: 10281 - DNA, 1380 bp, Homo sapiens
gccactccccactttgctatgtgggggaaggaccgggcaccggacggctcgggtactttcgttcttaattaggtcatgcccgtgtgagccaggaaagggctgtgtttatgggaagccagtaacactgtggcctactatctcttccgtggtgccatctacatttttgggactcgggaattatgaggtagaggtggaggcggagccggatgtcagaggtcctgaaatagtcaccatgggggaaaatgatccgcctgctgttgaagcccccttctcattccgatcgctttttggccttgatgatttgaaaataagtcctgttgcaccagatgcagatgctgttgctgcacagatcctgtcactgctgccattgaagttttttccaatcatcgtcattgggatcattgcattgatattagcactggccattggtctgggcatccacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagaccatgtgctccgatgactggaagggtcactacgcaaatgttgcctgtgcccaactgggtttcccaagctatgtgagttcagataacctcagagtgagctcgctggaggggcagttccgggaggagtttgtgtccatcgatcacctcttgccagatgacaaggtgactgcattacaccactcagtatatgtgagggagggatgtgcctctggccacgtggttaccttgcagtgcacagcctgtggtcatagaaggggctacagctcacgcatcgtgggtggaaacatgtccttgctctcgcagtggccctggcaggccagccttcagttccagggctaccacctgtgcgggggctctgtcatcacgcccctgtggatcatcactgctgcacactgtgtttatgacttgtacctccccaagtcatggaccatccaggtgggtctagtttccctgttggacaatccagccccatcccacttggtggagaagattgtctaccacagcaagtacaagccaaagaggctgggcaatgacatcgcccttatgaagctggccgggccactcacgttcaatggtacatctgggtctctatgtggttctgcagctcttcctttgtttcaagaggatttgcaattgctcattgaagcattcttatgatggctgctttataatccttgtcagatattaataattccaactcctgattcatgttggtgttggcatcagttgattatcttttctcattaaaattgtgatgctcctaaatcttg

SEQ ID NO: 10282 - DNA, 326 bp, Homo sapiens
gcctcggcctcccagagtgccgggattacaggcgtgagccaccgcgcccagcacctagtgtaagacttgacaccttctttatggtaacttttgattaatatgttatcttttctttttcttttagagacagaatctagttctgtcacccaggctagagtgcagtggtgatcagggctcactgcagcctctacctcccatgctcaagtgatcctcccatctcagcctcctgtgtggctgcgaccacaggcgtgcatcaccacacttggctatttttaaaattttttgtagagatgaggtctcactatgttgcccaggctggtcttgaa

SEQ ID NO: 10283 - DNA, 1633 bp, Homo sapiens
  misc_feature (18)..(18): n is a, c, g, or t
  misc_feature (97)..(97): n is a, c, g, or t
  misc_feature (113)..(113): n is a, c, g, or t
  misc_feature (120)..(120): n is a, c, g, or t
  misc_feature (377)..(377): n is a, c, g, or t
  misc_feature (432)..(432): n is a, c, g, or t
  misc_feature (477)..(477): n is a, c, g, or t
  misc_feature (487)..(487): n is a, c, g, or t
  misc_feature (750)..(750): n is a, c, g, or t
  misc_feature (855)..(855): n is a, c, g, or t
agcaagtcaaggggaccntcccctcccgctcctcccacactgcacagcgggttccagccagggcagtgaggcaagaacatggaactcaaatcaccgngattagcaaaaaagangtagaantacgcctcacgccgtaggtggaatcgcctaaggaatctacaaagataaaataaaatgaagtaaaacctgataagatgatcgaaggagtttaacaagatcatggggcgtaggatatttctgcactgacagtgaacaccccaagatgaaatgcagaaagcgtcctggtcaaatagcatcagaaagaataagctacttaggaataatttcgcaaaggaagtgtgagacttgtacgctgcaaactgcgaaacatggctggnaaaaagacccaaagaaaacctgaacagatggagagacttcccacatcgaggctgnaaggctgaaccctgcgcagacggcggggctcccgcggtgctccgngtggccttcntccccctctggccgtgttccctccccggctcagagccactcctcctagttaccaccctcggccctccctctgcaagcccaggatgcccgggccacaggccggtgagctggggatccagcctctcctggcgttttacccacgtaggtgacaactgacggcactggagcagagaggctgactgcccgaggagaccagggaggcttggaccccaggctggagggggccggggacccagacccactcacttgatttggaaggacacngggctgtcaaacctatgcagggtcatcacacccggcccttcgtttgtcccttttcggccaagctcaggaccctgtaacccaggaagacaagctcgtggttctganatgacccagggaattggccaatcccacccgaaacccttgttccttcctctggtcattgacgttcctcccagacggcttcgagagccccgcagatccttccactactccccagcctagaagatccagggacagaagccctcgaggttctggctgggcccacgtgctgagatgcctctgagaaagctgtctttccatggtggatcccgctggatgcccgtgaacacggggccagcttgcagagagctggaaggaggcctcctggcggcacccaggcctgacacagatttcatttctgattgcggaattttactctcaaaccaaaagatgttacatgccgctcctgacgccgtggcacggaatcacgccgcgtgtcccttgtttccggatttctcttctgtggcttattgatggcactcaagcaccacacagcaatgacgtctgtcctggcagggcacacgcactctgcgtctgaacgagtattgagctaattccaaagcccagcagagacgtgggcgcgcgtttatctggaggagaccaggcgcgccatggttggctctggccgcgggaccctgggctgagcaccgacccaggccaccccaagtcaccaaaagagggtagggaggggtggacaaaagtatttattttgcctattttcttgccagtgtccagattcaaatgtactgtttttaaactacattagcactttctgccctgtggcctgcaatgattgtgctgtgattattcaacaccataaataataatgcagcatttcaccatc

SEQ ID NO: 10284 - DNA, 1523 bp, Homo sapiens
  misc_feature (122)..(122): n is a, c, g, or t
cggccctctggcaagatggctgctgcggaggcgttggagcgcggaaatctggaaccgggatggcgacgtctacactgagtcggaggcgaagaatcctaacttagctcttcgtagctcttagnacacggtccgtgtggttgctgtctgatgggatgtcatgattcagcataaaatgggacagaagccctcgaggttctggctgggcccacgtgctgagatgcctctgagaaagctgtctttccatggtggatcccgctggatgcccgtgaacacggggccagcttgcagagagctggaaggaggcctcctggcggcacccaggcctgacacaggatggcacagcagatgcaaccgtgggcctggggcctggggttcctggttggtggccaggagaggcggccagaagactccatggctcccagggcccagtcgcagctgagaggctccccgtcacgatggccaatagccctttctccagggacaaggatggggtgatggcacaacatgtgtgggtcgagcacacctacccatgtgcacacatgggtgtgcatgtcctgctggtggctgacccgtgaccctgcatgcgtgtcctgctggtggctgacccgtgaccctgcatgcgtgtcctgctggtggctgacccgtgaccctgcatgcgtgtcctccgggtggctgacccgtgaccctgcatgcgtgtcctgctggtggctgacccgtgaccctgcatgcgtgtcctgcgggtggctgacccgtgaccctgcatgcgtgtcctgcgggtggctgacccgtgaccctgcatgcgtgtcctgcgggtggctgacccgtgaccctgcatgcgtgtcctgctggtggctgacccgtgaccttgcatgcgtgtcctgcgggtgggtgacctgtgaccctacaagcatgtcctgctcacgggcacaccgtctgcctgtgcacaggcctctgcctgcccacctggcggagtcctgcctggatgctttagcgtctccagcctctgtgcgctttgcttctttgctcggatttcatttctgattgcggaattttactctcaaaccaaaagatgttacatgccgctcctgacgccgtggcacggaatcacgccgcgtgtcccttgtttccggatttctcttctgtggcttattgatggcactcaagcaccacacagcaatgacgtctgtcctggcagggcacacgcactctgcgtctgaacgagtattgagctaattccaaagcccagcagagacgtgggcgcgcgtttatctggaggagaccaggcgcgccatggttggctctggccgcgggaccctgggctgagcaccgacccaggccaccccaagtcaccaaaagagggtagggaggggtggacaaaagtatttattttgcctattttcttgccagtgtccagattcaaatgtactgtttttaaactacattagcactttctgccctgtggcctgcaatgattgtgctgtgattattcaacaccataaataataatgcagcatttcaccatc

SEQ ID NO: 10285 - DNA, 488 bp, Homo sapiens
gggacatttcatttcaagagtgtgtcttgttgaggtggggcagaagggtttggtggttttatcagactgtttaaccataaaacgtttttcatccctgtgttcctgtgccccaccatttcaggcacttggtatttttactgcctcacccccatcaacagagaaaaggtggatttgatgtcatttattatatactttaaagtaattttattttgctgaatttgtaaatacatgcaaatgaaatattttagagctacaaaaacaaccatggccagatatgtatgaacgaggtctttcccagtccccctctgggttttgcacagatttattctgagggtcccttagtccaaactgggggatccgcagacaaagagatcaatatttttctcttctaaattcaaaaggcaaggtgcaggtatgagacattaaagtttgaaagaagacgctactgggaacatttttttccttctactccacccctatccagaata

SEQ ID NO: 10286 - DNA, 405 bp, Homo sapiens
tggccttcagtggagattttctttgaggcacagtgtcatgcagtggttaggggtggtgcgcaaagtaatacaccttgcaagttaggcccaggtcccccacttcctcagagagggaggagggataatcttgagacacatggtctttctgagtccatctcctctcaggcagaatggacctcccaggaaaactctcctcataggaggtatcccttaaccttaggcctgtaaagccgtatcttggtccttgcctcacggtgagcagcacatgtcagctcctgctgttgttccttcattgtgcgtcacagtggttgggcagtgagacccctgcaacctgactggcacttcctagccaagagcctcaggtggattgggagccaaatgctagcatcccaggtacagggtagc

SEQ ID NO: 10287 - DNA, 1009 bp, Homo sapiens
tctctgtcaaatttcccaacattgctgttgtagagtgtaagcagccatagacaattggcaaacaaatggatgtgactgtcttccagtcaaactttatttagtgaaacagacagcaggctagaatttgccaacctgtgcactcaaactatctgttgtgaggactcttccccccttttcccttaaaatttgtagatggacatttttgtaaaatacaataaaagtgaattattggatgagtaaaaaatacatggttaaaatttttagattacagacaacaagttacatttcaatctataatttaaatggtcatacatagggaaaaagaaaacaattagaagaaccataaatgttgttacttgaagatatcttctattaatatagagaatcgctgctatagtcataacttttttgtcattctgtaatactaactaaacacaaagccaagcaaaattgcagctctccatttattaaatgcccatactgtaaacaaacattgtatatatggatatttaacaattttaatatgacatagatttgctttttgctattagtttatctaatctaggttggattgacgacagtactactcacaagagataacgtatttgtatactactcctatattttgttttaacaacactcagtttagagaaaccagatttaaaaatatgttgctgggaactgaagacatttagatttaaaagaaattttagcaagctcaggatattcatgtctaacttttttccaaggtgaagcaagtgatttttttcagaattcattttctatctttcattagtagtcaattccaataatttatcctgtggaattacagttaaatttaaattatctctcaatgaataggttgtagatccacacatttcttttgtatgaatcttcttttggtggaaaaaatttgaaaatgtttttatcaaatttgtaaggttagtgataatttttcaacaaatataccatacctgattatacctacttcattgaaaattatggacca

SEQ ID NO: 10288 - DNA, 1360 bp, Homo sapiens
ctataagtgggcttgagctcgaccgcgcgcctgtggaagttctttctctactcgaaaaagggaaagcatttccttgagtttgcgttttaagggaaacttacagcattgacactttatttaaaatattcactactgctgtagaaaaaaaaaaaacaaaaccccgaaaaacagtggggctgtttctaagacgctgggaatcagtaaagaatagtgatccgggagatacaggaagcaaatgatctgcgctcaaaaagcgagctgctttcaaagatattagtattttatagatgcgatgcaggagagtgaactcaagcagagcccagccgattgcctgcgttggcaaaatagaacagatattctggggagaccaagcaaacagctttcaaaaatgaagactaactaggctggatgcagtggctcacacctataatcccagcactttggaaggccgaggtgggcagatcacgaggtcaggagatcaagaccatcctggctaacacagtgaaatcccccgtctccactagaaatacaaaaattagccaggcgtggtggcgggcacctgtagtcccagctactcgggaggctgaggcgggagaatggcatgagcctgggaggtggaggttgcagtgagccaagatcgtgccactgcactccagcctgggtgacagagcaagactgtctcaaaaaataaataaaaataaaaaagaaggctaactaaagacattcttaaacacacaaaaatggaaggaaattttcagcataagatcccacatgaaacaagaagttcttcaggcagaatgaaaatggcattagcttcaaatctgaatgtatacaaaggagtgaaatgtggtcctggctacttaggagtctgaggtgggaagatcacttgagcccagttcaaagctgtgatgagttggtcatgccattgcacttcagcctgggtaacaaagtgagaccctatctttaaaggaaaaaaaattgtgatgtgggttttataacatatgtaaaagtaaaatgtagcacaaagtgtgggagagaagaaataaaagtaaatttatatgcttgtatagtttctctgaagttttgttatcagttgaaggtgaactgatgagttaaaactgtgttctagactctctgaagcaatagtgccaacacactttagaagggctaccagtgagtcatttccttgtgtgatttctttctttctagtgcagatagaaattgtgaccaatagaatacaataaaggtgatgggatgtcattctattgattaggttgcttgttaggcagaggggatagcatgccactctcatgcctccatttccatgtatagcagaagcttagcagactgcacaaaaaaa

SEQ ID NO: 10289 - DNA, 460 bp, Homo sapiens
tttttacaagagacataaacaaagctatgtatgtgagtgaaaaactggaagcaggaactgtttttattaacacatacaacaagacagatgtggcggccccatttggcggagttaaacaatctggctttggaaaagacttaggtgaggaagctctaaatgaatatctcaaaaccaagacggtgacactggaatattagagcaacaccatcatcaggaaagccttgacagacagccctttacaactctggacacacttaagaagattgggtgtgttgaggcaggaggtgtcagccacaaaccaaaaaatacacagatggaccatgaagagggccaggccatgttaaagcatttacacatgtgcctgagtattttctaatacaccttccagtgatttggagttgttgcattttgactatgttgtatatcatacgtatttctaaaataccaagctgtttctccc

SEQ ID NO: 10290 - DNA, 477 bp, Homo sapiens
actgggtaacaacttttgaataattttattcccttgttagatctttgctatggcccaagaactctaggaatatttacaaaaataaaggatctttcttacctttcaaaaatgatccatggtgcagtttgaagagttgtggctagaatgagcttcatgatgtcccttaacatttttattcatcataatatgttcaaggcttaatgagatctggcacatggtagatatataatcagtgttttaaaaatgagtaatgagggtcaggcacggctgtaatctcaacactttgggaggccaaggtgggcggatcatgaggtcaagagatcaagaccatcctggccaacatggtgaaaccctacctgtaccaaaaatacaaaaattagctgggcctggtggcacatgcctgtagtcccagctacttgggagtttgaggcaggagaaccgcttgaacctgggaggctgaggttgcagtgagccgag

SEQ ID NO: 10291 - DNA, 960 bp, Homo sapiens
  misc_feature (505)..(505): n is a, c, g, or t
gtcaggacagctgtgagccagccaggggcaagcgtagacggggttttaccatgttggctaggcgggtcttgaactcctgacctcaagcgattcccctgcctcgacctcccaaagtgctaggattataggcacgagccaccgcccccagcccaagatatgttttagtaagccgccagttggatcatctgtaagcaactcactagaagcttccagcatcctccacaaatttgacaactgagaaatgtggctgggaaatcatgatttgggtccgaagaagtgaaagcaacaatcctcaggttgttgtttcttgagagaagaaggtaaacagcaggaattcggctgaggtgtccaaatctcggggaggatgaattctcaggagagctgaacctgagacaaagccctttgtcctgggctggaaggatcctggaaaggttatctggtccctgactcagggaagggaggcattctccctgcaggaatgttctcgatcacagtccaccaccanccccctacccccgcccacttttggagtccatcttcgcagcccttgatgattcattttatgtcagcttgacgggctaagggatgctcagatagctgggaaaacgtgatttctgggtggctctgggaagagactggcatctgaaccgggggactgagtaaagaagatccctcctcgccaggttggggcaccatcactccaatctgttgaaaagcccggacagaacaaagagacaagaggcagaggcaaggcaaaaccctccctctgcaagagctgggacatccaaggctgggcgcgggtggctcacgccctgtaatcccagcacttgggaggccgaggcaggtggatcaccctgagctcaagagtttgagaccaggcaacatggggaaaacccatctctactaacaatacacaatgaccgggcgtggttgggcacacactacaagtccccctaattc

SEQ ID NO: 10292 - DNA, 816 bp, Homo sapiens
attctataattgttttgtcacattaattgaacaatgagagggcaccagcattcctcactcatgaggtagaagcaccacatctacatttctttttagctatgggtgatgtttttgcttttaaatcttagaaatctgttaataaacaaataacacaacaaagtttggggtacttccttgtggggactgggatgcttaagctaaaacaaagtttaaatttggactgtgtgtgttatgtttcgcagaatctatatgtttctcaaaagtgggtgtcaccctccttcctcccccaacacacccttcaggggtaagaggagaagtaatgtagaaaaattaactgtttctccactgtaaaagtagggtgtctttagaatgtttcatgttcaaaggaaagattgtgcttctcccaaggcaaggtgttcccttaaaaaaaaaaaaaaaaaggttgagcatgtctttgtattgctgtctctggaagaggaaatgaggcatctcttggggtgagaacaagggagaattgaactctcgggcctggccagatggattcctcacactggcacagagctgtgaagggaagggcctttcatcctccagaggaaagagggctggggtctcagaggccagagcatagggacaggcaggagtcctgcagccctgatgcctgcccctcccagtacagaatctctgtcctgacccccacctgttgaacctttcaaatcccagtgactcgccagctttctctgtggatattggctgaattggtggcttgtgtggctgcctgggagagcaatttacccctgagccaaggagggggtgggc

SEQ ID NO: 10293 - DNA, 403 bp, Homo sapiens
taatccataaatgtagacatcacttcccacctttcgtatttgggatcattacagcttggagaagttcagtgaatttacccatggtcatacggtgacaaaactaatattagaaccaaatttgattttctccaaagcctgctttttaaaaatatactacctacatatttttctcttcagatccctataggaacatgtatttttactgcttcatggttcaaaaagttttttatttggaataaattaaaataactcgggtttagtgcttcctggttcacccaatttattaacatttacttcatgaatgtttgattagtaattactaaaataattttaatatttctctaacatcaagccagaaagaggattcttagtgggttctcccatcctatccatcatttttttc

SEQ ID NO: 10294 - DNA, 420 bp, Homo sapiens
gttcaaattagccaggtgcagtggctcatgcttgaagtcccagctacttggagagctgaggtgggatactcacttgagcccaggagtttgaggctgcagtgagctataatcatgccactgcgctctatcctgggcaacagagcgaggccccgtctctaaaaagaaaatgggctgggcacggtgactcacacctgtaatcctaacactttgggtggctgaggtgggaggatcacttgatcccaggagtttgagaccagcctgggcaacatggcaaaaccctgtctctacgaaaaatacaaaaaactggctaggcatggtgacatgtacctgtggttccagctatctagctatccgggaggtggaggcagaaggatcacctgagcccaggaggttgagactgcagtgatccatgatcacgcc

SEQ ID NO: 10295 - DNA, 170 bp, Homo sapiens
tacagggaaaaataataaacaaggaaatattttttcaagtcccccaaactattctgaaagcagccaggtttgagaacaggcattctcggtaacagccagcagaaatataaactgaaattgcccttcttgttgggagttcagggaggagatggcaatttgagtcaaaacta

SEQ ID NO: 10296 - DNA, 339 bp, Homo sapiens
tgtttaagctactcccagtcaatttcaaataaacagtagcagagttcgtttaagacgactgccattgctaacacagctgaatgaaatcagaggtctctttgtgggctcccagtagatccaggccctgtaggaccagttcacttgtccactgtagctaaatagatcatacaaaagggccaaatgaacagatctaccagataggaatatgatgaagtggcctgtggagaccgctgccacagtcactgtgtcatgccttctgtataccccagcccaattttaaaggagctttgcaagctgactcatctcacagtattgctgtgtttaatcataattggtctc

SEQ ID NO: 10297 - DNA, 322 bp, Homo sapiens
gcatttcaagatggtgacagcaaagcatcaaaccaagcatggggcccatctgagcaagggccctgtgtgactgcatggggtgcacactcatgaagccaggcttctgtccatcaactgtgtttttacaaccactccacgtgattccgtgcccactcaagtgtgaaaactacttcattaactctttttcattttaaaagtaatacctgtttgttaaagaaaccaggaaatacagatacatgcaaagaaggaaatgaaaaggaaagagaaccacaaatgatctcactacttagagataaataaactgttaactcttcatcataaa

SEQ ID NO: 10298 - DNA, 329 bp, Homo sapiens
tgtaatcccagctactcaagaggctgaggcaggagaatcgcttaaacctgggagacggaggctgaagtgagctgagatcgtgccactgcactccatcctgggtgacagagtgaaattcatctcaaaaaattaaagtaataatagtaataatacataaatattctagcattagtatcatctcatctcatcagaactcttcaaaatatttgtatgtactgcagctcaattagaggtggtctctgactttcatcagcttctccctgggctccatgacactggcctggagtgactcattgctctggttggttgagagagctcctttgccaaca

SEQ ID NO: 10299 - DNA, 471 bp, Homo sapiens
aattttcaccaacctgggcaacacggtgaaaccctgtctctactaaaaagtacaaaaagtagccgagtgtggtggcgagcacctgtagtcccggttactcaggaggctgaagtgagataattgcttgaacctgggaggcagacgttgtgatgagccgagatcacgccactacactctagcctggtcgatagagtgagaccctgtctcagaaaaagaaaaaagaagaattttcatagtcgttttatcataatagcacaaactgaaaatagcccaaatacccatcgataggagaataaataaataagtcgtaatatactgtgtaatgctaaacagcaactaacgagcactgctgctttgggccaggcatagtggctcatgcctgtaatcccagctctttgggaggccgaggcaagtgtatcacttgagatcaggagttcgagactagcctggtcaacatggtgaaaccctgtc

SEQ ID NO: 10300 - DNA, 601 bp, Homo sapiens
aaactgcttaggctatttttacacctacccaggttcaatcagtacctgttggctcatcttctttactgctggccacctcgctgtagctgcaacttggaaagaagcatgtcaatactacttgtttgggtagcctcctttgttcctattattgaaaatgaatgagtgaggggaagaatttaacccagaaatacagctcttgcttgtgacttttgttgtactgtgctcttcatgaggagccctggcgaactgataccagagtaactcacagactcagctgcttgagaacacagccatagtctcctcatcttatccccagcaccctacacagagcctggaccacagcagatgccccagctttgaaccaagcaactgaggcttatcctaggagatgcacacagacagatgcatgtgtgataagtgtcttttgagggccgattctatgcttggccctgagaatgctgctctggagaacaggaggcccaagttcacagcaaagcagaacatagggtgaactgagtcctaaatctcctccttgattttttttttttttaagagtctcactctccagcctgggtgacacagtgagacttggtctcggttc

SEQ ID NO: 10301 - DNA, 652 bp, Homo sapiens
aaactgcttaggctatttttacacctacccaggttcaatcagtacctgttggctcatcttctttactgctggccacctcgctgtagctgcaacttggaaagaagcatgtcaatactacttgtttgggtagcctcctttgttcctattattgaaaatgaatgagtgaggggaagaatttaacccagaaatacagctcttgcttgtgacttttgttgtactgtgctcttcatgaggagccctggcgaactgataccagagtaactcacagactcagctgcttgagaacacagccatagtctcctcatcttatccccagcaccctacacagagcctggaccacagcagatgccccagctttgaaccaagcaactgaggcttatcctaggagatgcacacagacagatgcatgtgtgataagtgtcttttgagggccgattctatgcttggccctgagaatgctgctctggagaacaggagaatcgcttgaatccgggaggtggaggttgcggtgagccaagatcgtgccattgtactacagcctgggcatcagagcgagactctgcctcgaggaaaaaaaaaaagaaaaagaaaattagagggtgaggcctgtttataaccctaaatgactgaccatatgagacagtgaaaaact

SEQ ID NO: 10302 - DNA, 658 bp, Homo sapiens
gatgcactgcttaaaactcaagggagggaacaaggcaagaggtagggagaacagtttggaggttgtcatattatccagcagcacagtggtgttatctcaatgggggaaggagcagaaggatggagagatggtgatggagtcacatgagtttctattttcttactcctcccacctcaggtaccctgcttccaccttttcaccagtctgaatccagttaaatagttttaactagatgacttaagactatttcaggaggaatatcctgtttgcagagagtaagaaagaaaattaggccaggtgcagtggctcacgcctgtaatcccagcactttgggagaccgaggcaggcggatcacctgaggtcaggagtttgaaaccagcttgacaacatggtgaaaccctgtctctactaaaaatacaaaaattagccaggcgtgatggcacacgcctgtagtctcagctacttagcaggctgaggcaggagaatcgcttgaatccgggaggtggaggttgcggtgagccaagatcgtgccattgtactacagcctgggcatcagagcgagactctgcctcgaggaaaaaaaaaaagaaaaagaaaattagagggtgaggcctgtttataaccctaaatgactgaccatatgagacagtgaaaaact

SEQ ID NO: 10303 - DNA, 934 bp, Homo sapiens
gcatttctgtataatgtgaagaagcaactgtatttgaattaaaaatcactgctaaagaatatatttgagtcatacagtttctaagggtacaacctgtgaagtcagacttcctgagttcagatctctcagccataactagctatctgaccttggccaagtatgctcaaagtcacaaaaccttagtttccttatgtgcatgatgattataataccttttgtacagttatgaggaaacttagacaatgcctgtgttgtatggtaagcgttttcataaatgctgcctacctgtaagtagcattatagtgtgtagttattggttaatttcctttttctttaccagaagtgtgggttttgcccagcctttatacaacttcagtatttctggttaatctgtctctctatggctctaaacttttcagagtggtgggggagttaccaacacttttgtaaaaggccagatagtaaatgttttatgctttatgtagtctctgttgcaagtactcaattctgtaattatagcgtgaaagcggccacagacttgtaaatgaatgagtacagctatgttctaataaaatttttatttacaaaaccatgtggtggactggatttggcctttgggccatattttgctgaccctgttttaaaccataagcttttctaagaattttttttttaatcccaataatgaagttacatagaaaatacttaatggtgtgtgaagagaatggtaatatgaaaatacagtcagtggctggtattttggcatctttttcttcagacaagctctttaaactcgcatatgttattcacacatgcctctttaacaattatgacaaaaatattcttcctggcttgcattctgtcacaatctgtgcagtatatagggcttaaggtattgtggaagagcttatgtagatcaatcatctgtgttaaa

SEQ ID NO: 10304 - DNA, 720 bp, Homo sapiens
ttggggtgctctaccggaccttacctaaatgcctgtgttgtatggtaagcgttttcataaatgctgcctacctgtaagtagcattatagtgtgtagttattggttaatttcctttttctttaccagaagtgtgggttttgcccagcctttatacaacttcagtatttctggttaatctgtctctctatggctctaaacttttcagagtggtgggggagttaccaacacttttgtaaaaggccagatagtaaatgttttatgctttatgtagtctctgttgcaagtactcaattctgtaattatagcgtgaaagcggccacagacttgtaaatgaatgagtacagctatgttctaataaaatttttatttacaaaaccatgtggtggactggatttggcctttgggccatattttgctgaccctgttttaaaccataagcttttctaagaattttttttttaatcccaataatgaagttacatagaaaatacttaatggtgtgtgaagagaatggtaatatgaaaatacagtcagtggctggtattttggcatctttttcttcagacaagctctttaaactcgcatatgttattcacacatgcctctttaacaattatgacaaaaatattcttcctggcttgcattctgtcacaatctgtgcagtatatagggcttaaggtattgtggaagagcttatgtagatcaatcatctgtgttaaa

SEQ ID NO: 10305 - DNA, 378 bp, Homo sapiens
gatgtctttcgtgttgacactttgtatctgttactctccaagtgcatttcatacattaactcctgcaatccttaccacaactccaggagggagatactaggctcccctttctacagatgaggaaactgaggcttgaagtggtcaagaagcctgtccaggcttcacatgggatgcgtgtggcagaaccaggattctaaccctaaagtagttagcaatatggaaataaaggaagcacaagtgtatcttcggagaattcataagagaaaggtttcccttgcttgggaagtgaggggatgacttcatagaggaggtgttgactgacgtgggtttgagcagtggatagaatatgtcattgtaggcctggtgcggtggcttatg

SEQ ID NO: 10306 - DNA, 486 bp, Homo sapiens
gggcaacatggtgagaccctgtgtctacaaaaaatacaaaaattaggcgtggtggctcgtgcctgtagtttcagctacttgggaggctgaggtgggaggatcacttgagcctggcaggtggaggctgcagtgagccaagatcatgccactgcactccagcctggctaatggagccagatcctgtcgttggatggtgttcaaggctgtccctggaagtgtggtagtagaagtgaagaaagagagcataccctgagtttccttaggccctggaaacagttttactgggtttcagatttgtttgggaataaagagcatagtaggaaggactgtccaatgtgctaacatctttattggatgttaaagagatatttcgtgtattaagtaattcattcagattcactagagcccatttttgccagatactatgttagatgctggtaatgcaaagatgaaaaaggtaagtgcttgcctttgaggaataactgg

SEQ ID NO: 10307 - DNA, 523 bp, Homo sapiens
tgagcttaggagtgagaaggctggatcaaagcctggctccatgcctgcatccctctgacttgccagtcatttcaccctccgagcctctatttccccacctcttaaatggggataataatactacctaccttatgggattgcggtaagactgataatgctggtacgagtgacagcttccctcatggaaggcccaccacgtaaagcagtttacagccatctcattccatctatgacagaatcctgtgtcactgttttggagatgggaaaaaagaggctcagagatggtgagtgacttgcataataattacataaaacccccagagcccctggcccctggagttctcaaaagttccttctctgttggtacctgcagctgccactccctaccccgctcccatagaccctctcctccttggagactctgccccatctgccgtcccttctctgctggatcaacaccttttccctctctgctggctcccatcagtatttaaacattgcctttcatatctgtcttcaagaa

SEQ ID NO: 10308 - DNA, 384 bp, Homo sapiens
ggcagggatactgaggaagacttttgaaaggcaacagttagagaccaggcagggagaagatctgtgcttcccagagcctccctgctccttgtgcttgaagggtagaaagtgaggcagaacgcaggaagggtgctcttacctgggagggctgaggctggcagaagtactgcttgaaatactcacccaggaggcctggcatggtggctcacatctgtaatcccagcactttgggaggccgaggagggcagatcacgaggtcaggagatcgagaccatcctggctaacatggtgaaaccccatctctactaaaaataaaaaaaattagctgggtgtggtggcgggcgcctgtagtcccagctactcaggaggttgaggcaggagaat

SEQ ID NO: 10309 - DNA, 357 bp, Homo sapiens
tgccgcacaatccagggtgagaactaatgaggatctgagcatagactgaaggagactggtgaggtatattaagactcaaaacatattcatgactggctacacataaaggttgaggggaaaaaggttgctttctatgccttcagaaattaacttaggaaaacaggtctaaaacccaaatggatcactaaccagttttatagcctagggccaattatttctcttaaatgttagctttttcttctgtcaaatggtgacaatgatagctgtccttgtcaactaggggatgatgtagcaatcaaatgaaacagaggacatgaaagggaggtcatcaccataaaggactgtgtctatggaagt

SEQ ID NO: 10310 - DNA, 495 bp, Homo sapiens
gaatgccctctcccttccctcacctgcagactctgacttaccttccaaggttatctcaggcggtctctcctccaggacgcctttcctccttgaggggcttaggatccccgctgagagctctgcccagaatctgggcttcgctgtcgtagcactgtactgtacattacctgttccctggtctggagattctcccaccttggcctcccaaagtgctgggattacaggcatgggtcactgcatccaggctcctttcttttatttttttctcattgaggtgaaattcatataacataaaactaatcatttttaagtaaacagtttagtgacagtttggacatttttgcagtgctgtgtgacaccacctcatctaattccaaaacattttcattaccgtgaaagaaagccccgtaccgggatgatgaaaagttctggagatggaggtggtgatggttacattaacaatgtgaatatacttaatgtcacaggattgtatat

SEQ ID NO: 10311 - DNA, 451 bp, Homo sapiens
ttaagagacagggtctctcactctgtcacccaggctagagtgcagtggtgggatcacagctcactgcagccttgaattcctgagctcgagtgatcctcctaccttagcctccctagtagctaggaccacaggcacacaccactaaatttttttttattttttttttgtagacacagagtgtgaccatgttgtccaggctcatctcgaacctctgggctcaaggggatcctcccaccacagtctctcaaagtgcagggattacagaaataagccaccacatttggccaaagttgtaaattttgcttattagtatgtgaatgctattttcaaactactcttaggcaccttttcaaagaaaccagaccatattttttttatctttcatatttttgatgtgtttataattcaatgagatatacaattctacataaaaagataaacactattgggt

SEQ ID NO: 10312 - DNA, 275 bp, Homo sapiens
tttcgcctctgagattccaagaactagctgggatgttctgaatcattagaatccattagttctgacccctgacttaaaaccctcccaaggctcctaggaccacccacactggcctgcccaatgctagccactaggtacctgcatgtggccactgagcgcttgaaatgtgctcctacccacaccagactttgaagatttagtaggaaacaaaaaaaggtaaatgtcattaatttttttttttgtctcttggcttaataaaacataataaaatcagg

SEQ ID NO: 10313 - DNA, 380 bp, Homo sapiens
gggaagtttcctgtgaaaacatatacaccataaagaataatgtatttagaatatctccctgttggtagtattacaattgaagcacagttgttgttactcattcctctcctcttacatgtaataatcaaataatacaacaacaaaaccaaatatagtaaaaataaattcactgcccgtggggaagaatcttaaatattacctttattgtatatgtttgaagtatgtttgtagctttagttgcatcttcatcactccttagcagtctccttgttcattgtttactgaatcatatgcctctgctattcttccagattttctctattctctgtagtccctcaaactgaaacttgcacctgacagttttagtaaatgaccatctt

SEQ ID NO: 10314 - DNA, 404 bp, Homo sapiens
atagctctgaactcaaaatatatccttgctaagatgatatatctgttattttactgctccttagtaaaattactgcaaaacttagtggcttgaaacaaccaccatttacttgcacatgattcagtgggtgtgcatattaagctgggctcacctgtgtggttcttctgctagtcttgtgtgggctcactgctttggttgcagccagttggtggctgggtcagctttgttgtccagaatgacctcaccctcaagtctggtggttagtgctgttggttgagcctctgcctccatgtgctcttttgtccagcttactttctatgggcatctcagcagcaagaatggaagctgcaaggccacgttatgttggtcaaaggaagggccagcgcagattcacaaggtgggaa

SEQ ID NO: 10315 - DNA, 435 bp, Homo sapiens
aacttctagcgagggcccttactgcaaaatagatgaaaggcatttttcagatttgtttttcccttttttaagaaaaaaatgaacgggaaggagccaatgtgtgagtgtgtatgtgtgtgtgtgtgtgtatgtgttgggggttgagggtattgatgcatgctatttattaatacaaactcaattagtcaaccacctcttgaacatttcattgggtgtttaatgggcatcaaacttacctgttcaaaaccaaattcttgatttctccccactacttcccaaactgctgctcctttggtctttcccatcccagtaattggctgctgcattctgccaagtgcacaggccaaagcccctcccttaggctcctcattcccaattgtcctggcatcccatcttctccacttccagcatttacacagcatccctcctccgctc

SEQ ID NO: 10316 - DNA, 443 bp, Homo sapiens
atgtgtagaagttgtcaaacatgaactccgtggaagtagatagtgggcctcctcccacacccacctactcccttgaggaagctccaggcagtacatttggaaagctaccaaacaggactacctctcaggacttctcttgttttattagtctctgagctgcctctttggttggtttatctggagtttttgtagcatcttctcactcatccacagcatgtcacttgttctctggatgaaggaggctccaagtcatgctagactgtggagttctggaactagagtatactgtttatttcctgtactggaagccagagttagggccaggctggattttatgtctgcacctaaaaccattcagtcccccacaaatgaatcaacctaattagtgctagactgttgtagctccctgagagcagggctctggccatcttaccactgtattc

SEQ ID NO: 10317 - DNA, 331 bp, Homo sapiens
ttttttattttacattggttaatatttataaatcaatgatttctgcatacttatttttatgaaatatatttgacatatgagatatgtatacttatttttatggaatacatttttattattgtaatcatttagctgttgagtcctaagatttcttatgtgctataatcctattatctacaaataataattgttttcttttttcactccgtaatctatagtttttttctttttacttgccttacttcattgactagtaagaaacttcattaactcgataactctagttataatgttgaagaaatgtgatagtaggtttaattatcatgtttag

SEQ ID NO: 10318 - DNA, 790 bp, Homo sapiens
gaggttttaaatttgcttttttgaggaaaagaactgggggtggattttggcatcgtagcatatcgattaaagaataatcaggacatcagatacattttaatacatagctggggccttatgttgtagatgaagcttgctgtttttagcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaagga

SEQ ID NO: 10319 - DNA, 1489 bp, Homo sapiens
gaggttttaaatttgcttttttgaggaaaagaactgggggtggattttggcatcgtagcatatcgattaaagaataatcaggacatcagatacattttaatacatagctggggccttatgttgtagatgaagcttgctgtttttagcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaaggaaaaaaacaaacaaaaaaagaaaaagaaaaaagcctcctccttgcccctaatttttttttcccatatggttttagccattccccatcactatattgtgaagctgtaaaaatatatatatatactttacaagagtttactaatggatttcaaaactggtctcaacgtttataatacatatctgtgtttggcagttgtcataacccaatcctacattcagccatcgggacaagtctgtcggggaggtagttcatggtttacaagcctttgctttttaactgtccaatttcctttaaagcacaactagctatttgtttacaaatgatatttttatgtatattttgtatagtgtatcatcatttttgccaaatatgtttttcattataaatgagtaaagagtacttaaggttgcattcatgtattacatgtttgttgttgtaaacctctccaatcagctggtagaaattctcctcattgtgttctatttggtcagtctctgtgtgattgtaggatgtgctccttggtagtactcccagctgtagatttaccagcttaaaagtttgttaggatctgtgcaataaagtgtttgcagtcttattttctctaagaaattccttatggacgtcataattgttgtatattgaacaaaatatttatacttatgcagttgcataacattgaaataaaaatttagcatgaaaa

SEQ ID NO: 10320 - DNA, 1896 bp, Homo sapiens
gaggttttaaatttgcttttttgaggaaaagaactgggggtggattttggcatcgtagcatatcgattaaagaataatcaggacatcagatacattttaatacatagctggggccttatgttgtagatgaagcttgctgtttttagcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaaggaaaaaaacaaacaaaaaaagaaaaagaaaaaagcctcctccttgcccctaatttttttttcccatatggttttagccattccccatcactatattgtgaagctgtaaaaatatatatatatactttacaagagtttactaatggatttcaaaactggtctcaacgtttataatacatatctgtgtttggcagttgtcataacccaatcctacattcagccatcgggacaagtctgtcggggaggtagttcatggtttacaagcctttgctttttaactgtccaatttcctttaaagcacaactagctatttgtttacaaatgatatttttatgtatattttgtatagtgtatcatcatttttgccaaatatgtttttcattataaatgagtaaagagtacttaaggttgcattcatgtattacatgtttgttgttgtaaacctctccaatcagctggtagaaattctcctcattgtgttctatttggtcagtctctgtgtgattgtaggatgtgctccttggtagtactcccagctgtagatttaccagcttaaaagtttgttaggatctgtgcaataaagtgtttgcagtcttattttctctaagaaattccttatggacgtcataattgttgtatattgaacaaaatatttatacttatgcagttgcataacattgaaataaaaatttagcatgaaaaaaaaaaaaaaaagaaaaaaaaagaaaaaaaaaaagaaaaaaaaaaaaaaaaaaaaaaaggggggggcaaaaaaagaaggaagcggcacaagcgtagcaaaccacaacaagagtgcaagagaaggggcagcacccaccaaccaagctactatgaaaagagcgaccaggcggcgcaataaaatagaaatgtctaaagagagaagcgcagcgcaacagaggacaatggaggaagagcaaacacatagtgacggatctgaaaaatacagaaaccacacctcagcaagggtaggaggccaccgacaacaaccaacatacaagctacaacgggggtcaaaaaaacatacagcagggggagagaagcaccacgcgacctggtgagacaaaccagcgaggagataaaatacagga

SEQ ID NO: 10321 - DNA, 1434 bp, Homo sapiens
gaggttttaaatttgcttttttgaggaaaagaactgggggtggattttggcatcgtagcatatcgattaaagaataatcaggacatcagatacattttaatacatagctggggccttatgttgtagatgaagcttgctgtttttagcaagttcctgggtttcacattcatttctgctgcatctagtagctccacacatttcataacctgatctctttatttgtatgcaaaaaatactgtcttaatacagagcagcatttttgtaacaaagagactcgctggagctatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaaggaaaaaaacaaacaaaaaaagaaaaagaaaaaagcctcctccttgcccctaatttttttttcccatatggttttagccattccccatcactatattgtgaagctgtaaaaatatatatatatactttacaagagtttactaatggatttcaaaactggtctcaacgtttataatacatatctgtgtttggcagttgtcataacccaatcctacattcagccatcgggacaagtctgtcggggaggtagttcatggtttacaagcctttgctttttaactgtccaatttcctttaaagcacaactagctatttgtttacaaatgatatttttatgtatattttgtatagtgtatcatcatttttgccaaatatgtttttcattataaatgagtaaagagtacttaaggttgcattcatgtattacatgtttgttgttgtaaacctctccaatcagctggtagaaattctcctcattgtgttctatttggtcagtctctgtgtgattgtaggatgtgctccttggtagtactcccagctgtagatttaccagcttaattccttatggacgtcataattgttgtatattgaacaaaatatttatacttatgcagttgcataacattgaaataaaaatttagcatgaaaa

SEQ ID NO: 10322 - DNA, 1436 bp, Homo sapiens
gaggttttaaatttgcttttttgaggaaaagaactgggggtggattttggcatcgtagcatatcgattaaagaataatcaggacatcagatacattttaatacatagctggggccttatgttgtagatgaagcttgctgtttttagcaagttcctgggtttcacattcatttctgctgcatctagtagctccacacatttcataacctgatctctttatttgtatgcaaactatttggtgcttgaatgtgaccatcctttttacttttgctaagccttatttaaattttgtataccgtggaatatgtagaatttgtcaaatcattttagtgctgaaggtttttgatttcttgtttttgtttctgttgttgcagtttctttggtggcttgttttgtattgtaagatggcacttgctgatataaatactaaggcactaagagaaaatacagataagtatttataagttgcttgggaaccatagcagaattttttgtttggttttgtaagagaaaaaaaattaccaataaataactgatctagcacccaaactctcttgggggatgtcttagtatcttcacgctataaaattgttcatctaagcacagcatcatcttatggccttatggattgtaaatcttctagtgaggctataaactccactctgaaaacaaaggcataacttaaccgactgctcagttgtccttcgttgtaaaatgaattggctttgggaaaaaggaaaaaaacaaacaaaaaaagaaaaagaaaaaagcctcctccttgcccctaatttttttttcccatatggttttagccattccccatcactatattgtgaagctgtaaaaatatatatatatactttacaagagtttactaatggatttcaaaactggtctcaacgtttataatacatatctgtgtttggcagttgtcataacccaatcctacattcagccatcgggacaagtctgtcggggaggtagttcatggtttacaagcctttgctttttaactgtccaatttcctttaaagcacaactagctatttgtttacaaatgatatttttatgtatattttgtatagtgtatcatcatttttgccaaatatgtttttcattataaatgagtaaagagtacttaaggttgcattcatgtattacatgtttgttgttgtaaacctctccaatcagctggtagaaattctcctcattgtgttctatttggtcagtctctgtgtgattgtaggatgtgctccttggtagtactcccagctgtagatttaccagcttaaaagtttgttaggatctgtgcaataaagtgtttgcagtcttattttctctaagaaattccttatggacgtcataattgttgtatattgaacaaaatatttatacttatgcagttgcataacattgaaataaaaatttagcatgaaaa

SEQ ID NO: 10323 - DNA, 417 bp, Homo sapiens
ttgttgactcaagccactgttttctttatagtacaacttcttcctggacttctctttttcattaatgtttccctaccctttaagagcttgttcatacacttgtgatccaacaccttatcattctgctcccatctagaatggtttcagtctgggcttacacatacattgcctcgggacttcccttcacttagatcccattttggtggagcatatcctccaatagccttctgagaaaaaaggtagatgggaggcaaatttttactctactctcacattcaatttatagtttaagatctgtttgttgctgatattctgaaatttcacagtgaaatacctttttttctttgagacagtctcgctctgttgcagtgagccgagatcgtgccactgcactccagcctgggcgacagagcaaga

SEQ ID NO: 10324 - DNA, 253 bp, Homo sapiens
ttttttttataacttttacctaacagcatctcttttttagatgaaggcaaacatgtctttttaaagcctggtttttctcaatacatctttaaaggttcttaaattatttcatacctggccaagttgaaatctttaagaatctcatttttaattttaattttttaattttaaactttatacttgatttttttcttttaaaaaaagaacttttaaatttttaattttaaactttactacttgattttttccccaa

SEQ ID NO: 10325 - DNA, 179 bp, Homo sapiens
tttgtaccttggggttttttgttttcttccttggatataataatgatttgtaataactacttttaagattttgctttgaaaaatcaggaatggactgtttatcatatatggtctttaaagataaaataagctatacaggctgattaagttagtttttttgcattaaaacattatttcct

SEQ ID NO: 10326 - DNA, 378 bp, Homo sapiens
gcgtcgacaaaaccctttaatcctcatcatgtactggatgtaagatccaaactccttgtaaagggcgtatgaaatcctctgcgatctgctccttgtctactcttggatcttgtccttagtaactccaaggcctcacactggatgcctcagctatctcagactacttccctgagatatcaagtaacatcggttggcaagaaagcaagataagttatctgccttcctagctaaccagtatctgttcaagaatctgctttccttcagggaaatcttcctgactgtcccctaagctagggtaggtttttttcctttatgctcctgtagaagtgtactgttaacatttatttcagacacaggacttcaccacacaagatttag

SEQ ID NO: 10327 - DNA, 496 bp, Homo sapiens
aatgacaggaatgtgaacaaaaatatttaggataaagaagtttaaaaattataagttctttacggtcatgttctaataaatttgaaaatctgaatgaaatggactgttctctaggaaaagatcaaaattggcttaagaaatctgcactagcaaaccgttgcagtcttttatttatttatttaattttctgtagagacagggttttgccatgttgcctggactggtcttgaactcctgagctcgagcagtcttcctgcctcagccttccagaatgctgggattacaagcatgaaccaatgtgcctagcctacagtcttttataaaattatcaaagaattcttttttaaaatggctgcaagtccaggtgttttacaagtggattgttttaaaatttcaacatgaaatatttaaagttatttaaactgtcccagaaggtagaaaaatcatccaaattcattttatgcagttagcatgaatctggtatcaaacagttggc

SEQ ID NO: 10328 - DNA, 1091 bp, Homo sapiens
tggtgtgaaattaaatcctttgactcaagtaaaggtagaggttttgaagtagaagcattaaatcctgctctttaattgttgtgtatttttaatatagtaatcaatggatactttataaaaatgtacattaccaagtatgtaacatcttctgttaatattgtcttatttgggaaagaaaatgtgtattgtattttagcatgcctgattaatctgaaaatggtagcagtgattcaatcttttttattctgtgaatgtttttgtttttattatgaaatatattaaaattgaaaagtacagagaataatcggtgtctactgtaacaccaccagatttaacaatgttaatgttacgccatatttgtttcaaatatttttgtaatattgaacattatggatagagttaaagcttgtttgtatccatcccgttgtttacattctccatcccctacataggtaaccactattctgaagttgatgtgtattctttgtgtacatgcttttataccttttctgcatatgtatgtatccataaataatatgtagtctgttgtgtgtttttaaactttacacagtggatgtcatactcttacatgtattctgcagcttgcatttttcacacattcattttgaatattcgttcatgttaacaatgtagatctagttttctttttaaactctgtatagtattcttatgtatgacatacacttgttgttatacatttgaattatttccaggtattcttttttgtgtgtggtatgtaaagtcacgatggcagagatttttgaaggaagataaattattttaggattacatttacagcgtcagtgcccacttcaaggtttatgaaaatttggatgcccagaaacaagtacttcgtagttggaggaataaaattctgtctgttgtgcagcttattattacaaagtcttactgttagaacaattatgtatataacacattcttaatcagttatttgaaatactttaaaattttcaatattcaattcatagcttttttctctgtttagaaaatattgtgtgtcttttttgatggagaagcaaattaaacatttgtcctgaattgaaaacctg

SEQ ID NO: 10329 - DNA, 1627 bp, Homo sapiens
tggtgtgaaattaaatcctttgactcaagtaaaggtagaggttttgaagtagaagcattaaatcctgctctttaattgttgtgtatttttaatatagtaatcaatggatactttataaaaatgtacattaccaagtatgtaacatcttctgttaatattgtcttatttgggaaagaaaatgtgtattgtattttagcatgcctgattaatctgaaaatggtagcagtgattcaatcttttttattctgtgaatgtttttgtttttattatgaaatatattaaaattgaaaagtacagagaataatcggtgtctactgtaacaccaccagatttaacaatgttaatgttacgccatatttgtttcaaatatttttgtaatattgaacattatggatagagttaaagcttgtttgtatccatcccgttgtttacattctccatcccctacataggtaaccactattctgaagttgatgtgtattctttgtgtacatgcttttataccttttctgcatatgtatgtatccataaataatatgtagtctgttgtgtgtttttaaactttacacagtggatgtcatactcttacatgtattctgcagcttgcatttttcacacattcattttgaatattcgttcatgttaacaatgtagatctagttttctttttaaactctgtatagtattcttatgtatgacatacacttgttgttatacatttgaattatttccaggtattcttttttgtgtgtggtatgtaaagtcacgatggcagagatttttgaaggaagataaattattttaggattacatttacagcgtcagtgcccacttcaaggtttatgaaaatttggatgcccagaaacaagtacttcgtagttggaggaataaaattctgtctgttgtgcagcttattattacaaagtcttactgttagaacaattatgtatataacacattcttaatcagttatttgaaatactttaaaattttcaatattcaattcatagcttttttctctgtttagaaaatattgtgtgtcttttttgatggagaagcaaattaaacatttgtcctgaattgaaaacctgaagatgtttcctataccttagacattgtaaggtagacatttaagtaaatttaatttctcagtcagccaggcagctcttaatctctgtctttataccgagtttttaccagatgatcacttttagtttgtttttgtttgcttgcttctttgtggggaaagaaatactaattttttttttttttttaccatatttcccttatctgcatgaatataattatcaggaactttgttcttaaatgtaactaagtcataaacagttccctacaaatttaggtttaataatggattcttctcagattgtatataagatcttttagctgttgttactttggaaacatcacattatggagtaggtttgtatttaaaatagtcacccaacataagttaaaaatacatagtgattctgtgaatactttagaatcattaggatatgtaggtaatttcatgtataatgttgctctactagaaaattagttctagataattagcatttttgtatacacttagtataaagtattggaaaaaatgcattattta

SEQ ID NO: 10330 - DNA, 362 bp, Homo sapiens
ggtgatccgcctgcctcggcctcccagagtgctgggattacaggtgtgagccaccatgcctggcctatacctggtactgttctaagctcttttatgtattaagttatttaatccttaaaacaaccctacaaggtaggccgttattatttccccccattttatagatgaggaaactgaggcatagcaacttaagaaacttgctcaaagctagcaagtggcacagctggaatttgaactcagccaatttggctcctaacctcatactcctgtaggctatgctattctgttgcaattttctgagttctggtctgtgttccacatcagactgggaggtcctcgaaggcagagcttgggcctgattc

SEQ ID NO: 10331 - DNA, 871 bp, Homo sapiens
cctcacaccaacaactgcacctactttcttacagggttggatgcctataacatgcctgcatggatttttgtcaaccgcagcctggcgctggggaagattcgttgctttggcttcgacatggactacactctggctgcctacaagtccccagcttatgaggccctgaccttcgagctgctgctggagcgcctggtgtgcattgggtacccgcatgagatcctgcgctacacctacgaccccaccttccccaccaggcggctggtgttcgatgaactctatgggaacctgctgaaggtggacgcccacgggaatgtgctgctgggtgcctatggcttcaccttcctctcggaggcagagatctggagcttctaccccagcaagttcattcagagggacgacctgcagtgtttctacatactcaacatgctcttcaacctgcctgaaacctacctctatgcctgcttggtggacttcttctctggctgctcccgttacactaattgtgacaccggctatcagcatgggaacctcttcatgtccttccgaagcctcttccaggatgtgactgatgccatgaataacatccaccagtcgggctgtctcaagaagaccctggaggacttggagaaatatgtgaagaaggatccacgcctccccatcctgctggggaagatgaaggaggttgggaaagtgtttctggccaccaacagcagctacaactacaccaatgccatcatgacctacctgttcagcatcagtgaggctgaagcctcgggcaggccctggaggtcctactttgacctgatcgtggtggacacgcagaagccccacttctttgcagaggggttggtcctgaggcaggtcaacacgg

SEQ ID NO: 10332 - DNA, 1103 bp, Homo sapiens
ccatgttgcccaggctcatgtgactaatttctgattcagacacagggtgctgggatcacaggcatgagccaccgcgcgctgcccacggtgtcctacttaacaaggcatctggcccagccatcattggaaatccacctggcttcagaaacagggtctcaccgtggcccaggccgagtgcagcggagccgtcatagcacactgaagccttgaactcctgggcacatgcgatcctcccacttcattgttccaaagtgctgagattacagatgtgagcctgactgggaatataaaatggatttttgtcaaccgcagcctggcgctggggaagattcgttgctttggcttcgacatggactacactctggctgcctacaagtccccagcttatgaggccctgaccttcgagctgctgctggagcgcctggtgtgcattgggtacccgcatgagatcctgcgctacacctacgaccccaccttccccaccaggcggctggtgttcgatgaactctatgggaacctgctgaaggtggacgcccacgggaatgtgctgctgggtgcctatggcttcaccttcctctcggaggcagagatctggagcttctaccccagcaagttcattcagagggacgacctgcagtgtttctacatactcaacatgctcttcaacctgcctgaaacctacctctatgcctgcttggtggacttcttctctggctgctcccgttacactaattgtgacaccggctatcagcatgggaacctcttcatgtccttccgaagcctcttccaggatgtgactgatgccatgaataacatccaccagtcgggctgtctcaagaagaccctggaggacttggagaaatatgtgaagaaggatccacgcctccccatcctgctggggaagatgaaggaggttgggaaagtgtttctggccaccaacagcagctacaactacaccaatgccatcatgacctacctgttcagcatcagtgaggctgaagcctcgggcaggccctggaggtcctactttgacctgatcgtggtggacacgcagaagccccacttctttgcagaggggttggtcctgaggcaggtcaacacgg

SEQ ID NO: 10333 - DNA, 533 bp, Homo sapiens
gaaaatccaaaagttatactatttgaattaataagttatttatttatttatttttgagaccgagactcgctctgtcacccaggctggagtgcagtggtgtgatcttggttcacttcaacctctgcctccaaggttcaagccattctcctgcctcagtctcccgagtagctgggactacaggcgcacaccaccacacccaggtcactcactccagaggaagccagctgctgtgtcatgaggcactcaagcagccatatggagaggctgatgtggtagggaactgagacctcctgccaacagccagcatcgtcttgccaggaggtcaccctgatgagctgcccatctaacagataagagcactgaggcagaggtgtttcatctgggcctcaggacccaaaatctgtttcattttggagcatccaggctgagctaggtcctgagccagacactgaggatgtgatagcaaatcaaacagacatgtcttctgtcctcttgaaatttacactccagtggggagacgcaaataaacaagt

SEQ ID NO: 10334 - DNA, 747 bp, Homo sapiens
  misc_feature (458)..(458): n is a, c, g, or t
ggtcactttctacacgatggtgctactgccttccagcctgcttaatagagcaagactctttcttaaaagaaaagaaaagagcatggggatgagattggcaaggagccagaatggcagctggaattctagtgggtgtgagggcagttgtccaggggaacatgggaagtggcctggccaagagtgtggcagaagaaatgggagaaatagatagattggagaaatatttaggaaagtaagaaggacttgcatgacttgggaagtacaggaaagggaggtatcaagaataacccctgggtccctgacttttataatggggtggtggtgatgtcaaatgcagagattgggaaggctggggcggggtgagggatgtgtatgtaggcacagtcaaaaagtttatttggaggcaggcatggtggctcacacctgtaatcccagtgctttaggaggatgaggaagtntgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcgggttggggaactgactgctgcagttgagaagaggtttggttttccagagggcagtgtagagctttatgctgataaggtggccgctaggggtctgtgccattgcccaggcagagtctctgcgttacaa

SEQ ID NO: 10335 - DNA, 364 bp, Homo sapiens
  misc_feature (103)..(103): n is a, c, g, or t
tttaatatgatcgcttgttctcacgtcttgactccttcccttgggctttttcgtccggccattggcgagcgcccggagtctccttcaactgccgcttcacaanaagaggtaccaggtccgcaccaaacgagcacacaagcagcaccaggagcggcagaagaaggaggcaccaaccaggacagaaatcattatcttagccaccagaacacagaatgttcttggtgagaagggccggcgggttggggaactgactgctgcagttgagaagaggtttggttttccagagggcagtgtagagctttatgctgataaggtggccgctaggggtctgtgccattgcccaggcagagtctctgcgttacaa

SEQ ID NO: 10336 - DNA, 406 bp, Homo sapiens
ggtttcaccatattggcctgtctggtcttgaactcctgaccttgtgatctgcctgctttggcgtcccaaagtgctgggattagacgtgagccactgtgcccggccacatttgtacttccataagcaataaagacttagttaagaaactgcagaaaattacaaaagaggaggaaacctccataggcctaccattaaaagacatctgtcatctcaaaattttgtagtattttattcaatgctttttcagtcataggtttttatttacctttttcttttttttcctttaaagtaattatcttctctgtattgttcacagttttagtatatgtgctgctgaagtgagcactaccattacttttctttatacttagattaatctgaaagtttttttgttttttgagacgga

SEQ ID NO: 10337 - DNA, 377 bp, Homo sapiens
cttgtcctacaatgtcctcttagaagaaagagcagcaatgaaacactaggtctcatctgacctggacttacagatgaattgacctgatgcacagttagagaaagggaaagttcccacaggcataacagccagacacatattccttacacattacaatgtctgcatttttcatcattaccctaagcttcttgaaaaattagtgagaccgtttcttatgacctatgaaccagaagaacttgccacagcactctgataaagaaatagctttaaggctgggcatggtggctcacacctgtaatcctagcgctttgggaggctgaagtgggaggatcacttgaggtcaggagttcgagaccagcctgaccaacatggcgaaa

SEQ ID NO: 10338 - DNA, 372 bp, Homo sapiens
aggcaactttcttctggattctgtaggtctcaacagtcagccattggcttgttgttagtactttgatttattttttcttaccttgtgtgtgtatgtacactatctgacttgaggtttactaaattcttgtataggtggactaaagtcttttactagtttttaacaagttaagctattataaaccttctaaaattgtttttgtattattttctcttgtttctccacctgagacaacacatacatatgttgtaactttaaactgtgtctcagatcttctttattctctggtatcttctattcattcttttgtgaatgttatgcatttactttgcttcaagttgtcaactcttttcttctattttcagtctccac

SEQ ID NO: 10339 - DNA, 487 bp, Homo sapiens
gaagaattgtaaatacttataggtccattaaaaataacaataatgagccaccgcacccagcctgactattgattcttgattgaagaatgtttagtgttgatttttgattcctcaggaggcagtttaattattggcaaattacagtgaacttgtgttggcttgtttttttgccctaatagcaaggatttgaaggaagttcaaagtgtttcccaagcccttctaatttggcaggactcagcttccaaattctgtctcttttgcagatcttgtcagctcttgggttttaggttttgttagggatgagtctataatttttaggggcacagcctttctgtgggtgcctcagtaggagggtggggcaattaatgaggggttaaggcaatatctccactctgacaaggctaaaccctactgttcccaggatagctcttctctagcaccactagacctcaggatattggttttgttctcaaccccatagcagctg

SEQ ID NO: 10340 - DNA, 439 bp, Homo sapiens
agcagtcactttatggtatacttaacatcactttatttaaaacatttgaaatcaatgtaaaattagtgcaaatatagagctttctcattatgaagatcagctcatttaatataatctgtagatggaataaaatcttgaagataaagaattaccaggccagatgcaatggttcacatctgtaatctcagcactttggaaggccaaggtaaaaggatcacttgagcccaggagtttgagaccagtctgagcaacataacaagaccccctctcaacaaaacaaaacaaattagccaggcatggtggagtgtgcatatagtcctagctacttgggaggctgaggtggaaggatcgcctgagccccaggaggtcaaggctgcagtgagccatgttcatgccactgcactccagcccaggcaacagtataagaccctgtctcaaa

SEQ ID NO: 10341 - DNA, 420 bp, Homo sapiens
tgttttcaaggttaatccatgttgtagcgtttctttcctttttattgccaaataatattttgttgtatgactataccatattttatttttcctttcatcagttgatggacattggggttgtgttcatattttggctattatgaatactgctgctgtgaacatttgtgaacaggtttttgtgtgggtgtgtatgtttatcttgcttgggtaactacctaggagtggaattgctgggtcctgtggtaactttgtatttaactttttgaggagctgtcaaactgttttcccaagcagctccatcattgtacagcctcactagtaatctataaaggttcttactgctccacattgtcaccaacacttgttatttttcatgtttaaaaaaataataaatatcctattgggtgtgtgaagtagtat

SEQ ID NO: 10342 - DNA, 393 bp, Homo sapiens
aatattatttggctcgaaaaggaatcaagtgctgatacatgctacaacatagatccttgaaaccttacactaagtgacaaaagccagtcataatagaccacatagtgcatgattattatttttttctttatcaagttgattatatttttatgaaatttttagaataggcatatccatagagacaggaagtagattaaagattgtattgggctggagtgaatagtggtaagaggtgataggggagtgactgctaatggattttggggtttctttttggagttatgaaaatgttctataactggatagtggtagtggttgtacaaccctgtgaatataaacaactttaaatgggtgaattgcatggtatttgaattacatcagtaaaactactaa

SEQ ID NO: 10343 - DNA, 363 bp, Homo sapiens
tggtacagttccttagaaccaaatttaaacatttccaaatgtttcatcataaaagcaatacatattcaagataaatattcaaacaatacataaggatggaaagtgtgaaataaaagtgtaaatgggactttttgctcacattctgagaacactatttcccaaacattctctgctgtagaaataatactttcttgattccaattctcatagaccaatacttttgtaaaatacattaaaattactgagttgggcgtggtggctcatgcctgtaatcctggcactttggaaggctgaggtgggcagatcacttgagcccaagggttcaagaccagcctgggcaatatggcaaaaccccatctttac

SEQ ID NO: 10344 - DNA, 353 bp, Homo sapiens
aaagttttaaggtatataagtgtattatgacaggtagctataaaggcgtataagtgtattattatttaaggtgtataagtgtattatgaaagaggtatattatgacaggtagctataaagaaatcggttttttgataggaggctgccaaagaaagaatctcacatttccattccgtgtacaggatgtttccatttcaacctttgggtcccacagtgtgacacagcaagccccacgccagggaaccagcacaggttgtggagcgacagagcctgcattctgagtctcaggcccacttccagctgtccccttagtcacatcacctcacctttcagaactctggtttctttgcatc

SEQ ID NO: 10345 - DNA, 372 bp, Homo sapiens
aaatttaaccacattaaatattctgtccattaagattccccaaagatggtggaaagatggcaggttagtgggagaagatatttgcagcatgcaaggcaagatgacaatgcactaataacaaaatttcataaaacaatggacttggggcttgggaaaaataattatgacatgctttctgaagtgtccccagatagtttcataaaaaatggagcaaataggctaaagaaaaacccatagacatcatgttcaaaagaactgatgacaaggcatgttcataacccataaaatacaagtggatgcagctaaataactgcaatacttttgaaagagtttggcaggtttcgaagatgtgaggagctacaaagcagatta

SEQ ID NO: 10346 - DNA, 819 bp, Homo sapiens
aagaaatgagtacatgaggcagcacatttctagaatgttgtacagatgtcaattctcaaattagtctacaaatttaatgtaatcctattcaaatcctcagatagtttttggtggtggctgtttttgagacagggcctcgctctgttgcccaggctagagtgcagtggtatgactacagatcactgcatcctcgacctcccaggctcaagcaatcctcccacttcagcctctgaagtctctcatatggtgtccgagaaatggggacaaatctcacaaagggactaggctcaggagggctggaatattcagggaaggtttcaagcagaaagatgaacttgagttggcttttgagagattcataggattcccacaggcagagtgaaataagggaattttagatgaacaaacgcacagacaaaagcagaaatgcagatggtgtgactgggggatggtgaggggctgctctggctggaatggagggctggctgccacaatagtggaaatggtaaatgaggcaaataaggttggattggtaggatagcatcaaggttgccagcttattaaatcactcttccaatatgctagcactggcctattgggaaaagtaatgcatcatgtaatcaaactagagtggccagatgtagactttagatatgttaatgcaggttgagcatctctaatccgagggggaatgtctcatatggtgtccaagaaatggacacatctcacagagggcctagactcaggagggctacagtatgagacatttcccctcccttgtgaacttaaaaatgtggccaacaatttttttaaaagatg

SEQ ID NO: 10347 - DNA, 873 bp, Homo sapiens
aagaaatgagtacatgaggcagcacatttctagaatgttgtacagatgtcaattctcaaattagtctacaaatttaatgtaatcctattcaaatcctcagatagtttttggtggtggctgtttttgagacagggcctcgctctgttgcccaggctagagtgcagtggtatgactacagatcactgcatcctcgacctcccaggctcaagcaatcctcccacttcagcctctgaagtctctcatatggtgtccgagaaatggggacaaatctcacaaagggactaggctcaggagggctggaatattcagggaaggtttcaagcagaaagatgaacttgagttggcttttgagagattcataggattcccacaggcagagtgaaataagggaattttagatgaacaaacgcacagacaaaagcagaaatgcagatggtgtgactgggggatggtgaggggctgctctggctggaatggagggctggctgccacaatagtggaaatggtaaatgaggcaaataaggttggattggtaggatagcatcaaggttgccagcttattaaatcactcttccaatatgctagcactggcctattgggaaaagtaatgcatcatgtaatcaaacaaaaggcaaacagaggcaagctccaggaatgggcactgtaaacaggactcaccctagagtggccagatgtagactttagatatgttaatgcaggttgagcatctctaatccgagggggaatgtctcatatggtgtccaagaaatggacacatctcacagagggcctagactcaggagggctacagtatgagacatttcccctcccttgtgaacttaaaaatgtggccaacaatttttttaaaagatg

SEQ ID NO: 10348 - DNA, 508 bp, Homo sapiens
gcccaaattgtaattttattaaatgagtggaaagaaaattacttcctaataatactgatatatgaggatttcccatattcttgacctgctgttaggcttttaataggcatctcatttaatcgcactacatcgagggtctgggcccagcacctcctatctccaagtctgacatcccttcttggacactactgttcctgtatatcttttgttatgtgcattcattaccttttgtaacatatgtgcactttgcttgctccgaagtctatggtatgcacatgtacctcacctacttcccttcactgtgatggctgatgatttttcccccagcttccgtggctatgtcacatgtccagttcattcctcgtaggtgctggaggtagtgatcaaaaggcacaaaactagagtccctgtgactgactgtgacccagcagaaagagtgcccatcacccaacctgtatttgcctgcaggtgcattcccatgtgtgtacatcaaatatcctggtcagga

SEQ ID NO: 10349 - DNA, 447 bp, Homo sapiens
cgtggacaaggatgaacaaatgtgcagaaatctgtggcatgttttagtttatttcagcccttctcaaaaacgtcgtgtattttgggaaaagcttcctagaaacctgaggcccctgtgccttcatcctgaaacgtccttggattaagttgctttacaaacttcttttttccaattttagtatcaactttaagattcccaaagaagacctttcatttatgatttttttgaagacatagtcatggtgttattaagaagatattcactgaaaatatttatatcctgattgaagattatgcttttcagtttattcacttttatctttttttaaataatagttttattgagatacagttcacatataaaattcactcttttaaagtgtacagttcagtgggttttggtgtattcatagagttgtacaactatcgctattatctaatttcagaa

SEQ ID NO: 10350 - DNA, 410 bp, Homo sapiens
gaagggaagacttccagttgcaaggtcaggtgacccaatcaactgcctttgaacatctggaaaaatcttctaaaactcttccttctcaagaagtcctgcaactggagctactaatgaaagctctttccagtagcccttacagctaattttctgttcacatatttgtcttctgctgtaaagagctgtgcctcatagtgtattaagggctggcttttcctttcattgtaagggactttccaccacaaacacaaggccaccatggccagcaatgcacaaaacagcagagtatggtcggcccttaaagacaaggtttgacttactcctctcttctcttttttacagacatgtttctctactataaacttcactcttagctttattttcaagaataaaatatttctgttttcaaa

SEQ ID NO: 10351 - DNA, 347 bp, Homo sapiens
tggctagggcatccagtggctgtcacttccccaccctggtatagtcctgtttgctcaaaagattccaggccaggtgcagtgctcacacctgtaatcccagcactttgggggtcaaggtgggtggatcacctgaggtcaggagttagagaccagcccaggcaacatggcgaaaccctgtctctgctaaaaatacaaaaattggctgggcgtggtggtgcacggctgtaataccagctacttgggaggctgaggcatgaaaacagcttgaacccaggaggcagaggttgcagtgagctgagatcacgccattgcactccagcctgggcgacggcgagactgtctcaaaa

SEQ ID NO: 10352 - DNA, 288 bp, Homo sapiens
tttttatttttcctgtgttgcccaggttgattttgaactcctgggttcaagtgatcctcctgccttggcctcccaaagtgctggaattccaggcaagagccaccatgcctggccctgggcaacatttttattgtcagtcatttaatagcctagtctaatggatgtgtagtgatatgtcattgtgattttaatttgcctttccttaatgactaatgatgctgaacactttttttatgtgctttttttttttgccatttataaattttcctttgtgaagtttaagtcttg

SEQ ID NO: 10353 - DNA, 802 bp, Homo sapiens
ccaggcaactacaacaagcgtccataaggccaggtgcagcggctcacacctgcaatcccagcaatttgggaggccaaggcaggaggatcgcttgtgcagtggctcacacctataatcccagcactttgggaggccaaggcaggaggatcgcttgtgcagtggctcacacctgtaatcccagcactttgggaggccaaggcaagaggatcgcttgtgcagcagctcgcacctgtaatcccagcactttgggaggccaaggcaggaggatcgctcgaggccaggagttccagaccagcctgggcaacatagcgagacccccacctctacaaaaaattttaaaaattagccagaggtgggggtgcacacctgtagtcccagctactcaggaggccgaagcaggaggatcacttgagcccaggtatttgaggctgcagtgagctatgatcacactactacactccagcctgggtgtcagagtgataactctctcacaaattcaaaaaaacacaaactgtccatgatcacagcatggccctaaatttctagctgcaggtgtaatttctactttctgggactctcaacctaaaggaggcaggatcacacctcctcaagggcctgggcagggaggggaggccaccgtccctccctgtccccctagggcggtctccttccacttcctcaggccaacctttgccaaagaggcctctctgtagagtgaccagctcacagggcacaccacctcccttgagggttccctccttctgggagtgtaacatgactgtccaggcaagtaccttctcca

SEQ ID NO: 10354 - DNA, 297 bp, Homo sapiens
tctgattgcagaactagtaggtcctaatgttaaaacacctggaaagcatagaaaagcaaaagaataaaagaattctgtcaaactggatatggttttgaatcatgtttttctgttataccatgactattttcctttgtcattcaaactgcttcagaattgtttaaaattaaattgacaaatttgagacacaaaacctttctagaatatttatctttgatgaatgaaaactcttggaaagactttgtttaaagaaatttccctaaagtattggagtccataaggtatgatgaactttag

SEQ ID NO: 10355 - DNA, 382 bp, Homo sapiens
tcaaccttttaaaaattatagcaaccatgcttgcggacagtccaaaaacacaccatgggccatactttgcctatcctggtataaaacaagtaaatcttctgagcagtatttaagataagcccaggacagttagtaacataggaaaagatctggataagcctggttgagaatttcaacattgcaattttttaatttttaaaaatttaatttcttcaataattattgaattaatttgcatttattttgttagccaagtgggagtgatttttgaatttttaaggaggctattattgggtgggttttataagatgacttgccaagtatatttgggataaccataagaaataccattataagatctcagaagggaggtgggacttct

SEQ ID NO: 10356 - DNA, 316 bp, Homo sapiens
aaaaaaagaaaattgaatctacaataactgtagtaattatactttgaaataaatttaaccaaaaagtggaaaaacctgtgcattataatctaaacaatattgaagtacaaaattaaataatacacaaatggaaaaatattacctataaatgaattagcattattattgttaaatatctgtattacacaaaataatctacagacataatgcaacctctatgaaaataccagtgacacactggtataaattttaaaacatacatctaaaatttatattgtaccacagaagacccaaagtagccaaagcaataaagaaa

SEQ ID NO: 10357 - DNA, 362 bp, Homo sapiens
ttagttttttttgcataagaatgaaagtagtaagtgtgtacttttacgtgtgtattttcctctaaatgtgttctatataagaactgaaatttttaattaaaatttatttcccctattaggctgggcgcagtggctcacgcctgtaatcccagcactttgggaggctgaggcgggcggatcacctgaggtcaggagttcgagaccagcctggccaacatggtgaaactctgtctctgctaaaaatacaaaaattagccaggcctggtggcacacgcctgtaatcccagctactcgggaggctgaggcaggagaatcacttgaacccaggaggcagaggttacagtgagccgagattgcgccac

SEQ ID NO: 10358 - DNA, 405 bp, Homo sapiens
gatcccacccaacacgagaaggcaggccagaaaatcaattaattacaagttgtaatgagtgtgtacttcaattgggcttatcagaggatcctctaaggaagtgacatgtgagctgagagtttgctgacaagattgagctaggtttgtaaagaatgtcaaaaggaggattctaggtggaaaaagtaaaatatgcaaagcccctgacgtagaaaataacttggggttctaaggatgagcttagcagacaccgggtaagagacagcaggaggcgtgccatgccctggaagaggtaacatgctagcttaaggcaattccaagggatagaagagagacaatagctgggctcggtggctcatccctgtaatcgcagcactttgggaggccgaggtggactgatcacgaggt

SEQ ID NO: 10359 - DNA, 594 bp, Homo sapiens
accccggcaccaatatatttctctctccacaaattaagatattgttttcttagaggcatagccttgcacccacagtcttgtttttggagtgtgtgactgctacttatatgatgaccttgccttgaacgtctctcacctggctcaatgccaggctgcagaggtatcactcattgctttcaactcaggatgaagagcgcgagcttcactgtgtacagagtcatctccgagggattacacagagtacaacaaaaggagaaggctcagtccttgacataagcaaagatatctgcggacagttgactgtaggattgtaaagtctcataactgccaggcatagtcgtcacgcctctaatcccagcacttagagaggcagaggcaagaagatagcgtaagcccagcagttcaagaccagcccgggcaatatagtgagaccccgttctccacaaaaaggaaaaaaaaagccaaaaaaaaaaagtcttgtaaccaataaacagaaattataagccatattgaaaaggcagtaggaagccaagctagaatcatttagataattgatgcttgagaaagatgcctttttaccagtacagtaaaagt

SEQ ID NO: 10360 - DNA, 442 bp, Homo sapiens
gaactaataatttaaaataaagaggctttgctttaatatcacactcaattttgccccttgtaaaagaataagtcggatagttaaacaatttaccctgatacgctgggtgccctgcccaaggtacttgcccggttttaatcctaaaatatgtcctgcccagggggacaaatgagagggattcctccattttgcatctgtgtttcatacctgtgctcttagcaaaggagtaggttgtgggggagaaggagggtcttttatattcagctgtatgtactatttgacatcagagaccccatgaataatcactcttttttccattcggccaccagctagcaggttgcaattctttcctacctggagcgctgcagggggtggggcaagtggagacattactggacatttgcatttaaagaattaataaaaattccttatttgcctgaaa

SEQ ID NO: 10361 - DNA, 427 bp, Homo sapiens
tagcaggaatttatatcaagtatcactgtacttgatacaaattccttcccctcctagcagtctgggtatacccttccgtacctcaggtacagagacagactccctttcctgcactgtcttcttttcaaattaaagcctattctccttgccaacacaatgattcatctaccctttcctttctgtaaaagggcagaaccttaaaattatatctcttggtgctgtgaatgcttttctcttatatttgtcttttaaatacaaagttgggcactgactctctaaaaatatgcacaccaaatgcttggttgaggcaatgtgggatggtagaaagaatataggtttgaaagggtgcagattctcgctctatcccctataagtgtgaccttgagaaagttacctttgtctgaattactccaatggaaaaggtggg

SEQ ID NO: 10362 - DNA, 485 bp, Homo sapiens
ggatagtgaaagtaagatcactctcaattcctacttcctggtcattgagcctttgcgtagtctccttccatatcatatcagagttggctgtgtgaccaacaaaatatggcagaattgacgctatgtcacttctgaggctggtgtatgaaaagcactgcagctttctgcgctctcatggcctctctttctctctctctctttccctcttcctcccacagataactcaatctgggggaaagtcagctgccatttatgaacagccctatggagaggccctcaaagtcaagggactgtagtgtctgacaggagccatgtgagtgggctcagaagcagactctccagtcgcagtcaagcctacgatgactgcagccccaaccaacaactgaataaccacgtcatgatagatactgagccagaatcacccagctaagctgctctcaaattcctgatcacagaaagtgtgagataataaatgtttgttatct

SEQ ID NO: 10363 - DNA, 1007 bp, Homo sapiens
gtggcttctatatagataattagataattgagtttgatttagcactttatatgggaacgcaaaggtctggacaaataagtactttggaagagttgaaatagaaactgggcagttaagcttatttaatatgtaacaaccatcagtggatagataaataagtcttgatagggagaatttcttaatatcttttgaagaatacctccattttcatagtagggagtacccagaggataattttcggagccagtacagtggaattgaccagcaaaagttagttaaagctagtttcttgaatattgataatatattcaacatggtacagtctacatacaaagaggccgagatgggcagatcacttgagtccaggagttctgagactagcctaggtaatgtggtgaaaccctgtctctctaaaacattaaaaaaaattagctgggtgtggtggcacatgcctgtggttccagctacttgacaggctgaagatgggaggatcacctgagcccagggaggttaaggttgcagtgagctttgattacaccactgcactccaccctggccaacagagtgagactttgtctcaaaaaaaaaaaaaagaaaaagaaaaaaagtggtcacccttaaaggtgggaagagttgaggtataagtagtagatatgatttaatagttattcttcttggaaaaaattattttttaaaaagaaagattgtaccagttttttactaagttgttggattgagtaatatttttaagaagctttttcctgtttactactcagattattagtgatcctgtttttgggtagcatgatagaccaagtattaaatagttttaacttggaaggctgtagagatgaacatcaaaacactgggggaaaaaaaggtatatatatgtcacttgatagtctgtatgctaaggtctctatgaacagattggaaattaatagattcacttttaacttaaaatagatctcataattccaaatagagcattaataggaagaaattat

SEQ ID NO: 10364 - DNA, 645 bp, Homo sapiens
tgagacaggtttttgctctgttgcccaggctggagtgcagtggcatgaacgtggctcacggcaacttccatgtcccgggcttaagccatcctcccacctcagctacttgacaggctgaagatgggaggatcacctgagcccagggaggttaaggttgcagtgagctttgattacaccactgcactccaccctggccaacagagtgagactttgtctcaaaaaaaaaaaaaagaaaaagaaaaaaagtggtcacccttaaaggtgggaagagttgaggtataagtagtagatatgatttaatagttattcttcttggaaaaaattattttttaaaaagaaagattgtaccagttttttactaagttgttggattgagtaatatttttaagaagctttttcctgtttactactcagattattagtgatcctgtttttgggtagcatgatagaccaagtattaaatagttttaacttggaaggctgtagagatgaacatcaaaacactgggggaaaaaaaggtatatatatgtcacttgatagtctgtatgctaaggtctctatgaacagattggaaattaatagattcacttttaacttaaaatagatctcataattccaaatagagcattaataggaagaaattat

SEQ ID NO: 10365 - DNA, 398 bp, Homo sapiens
gcggccgctactactactaaattcgcggccgtcgactaatgagcaaaatatattaattccctgttcttaaggagaccacattctagtggagggaatcgacaatagaccaatatatgcctggcacgttggctcacgcctgtaatcccagcactttgggaggctgaggtgggcggatcacaaggtcaagaggcggagaccatcctcgccaacatggtgaaaccctgtctctactaaaaatacagaaaaaattaggtggacatggtagcgcgtgcctgtagtcccagctactctggaggctgaggcaggagaatcgcttgaacccgggaggcaggggctgcagtgagctgagatcgtgccattacactccagactgcacaacagagtgagactccatctcc

SEQ ID NO: 10366 - DNA, 377 bp, Homo sapiens
agacatccatctctaatcatatttttccttaaatcaacttaaaatagcttaaagacttagagcagaaactatgaaactactagaagaaaatatgaagaaaaattttcaggacattggtcttggcaaagattttatagagaaaacctcaaaagcacaaacaaaaaaagaaaaaataaacaggactataacaaactaaaaagcttcggcacagcaaaggaaatgatcaatagagagaagagatgacttgcagaatgggaaagaatattagcaaactattcatctgacaaaggattcatatccagaatatacaaggaactcaaacagctcaacatggaaaaaacacacaaataatctgatgtataaatgggcatattagc

SEQ ID NO: 10367 - DNA, 284 bp, Homo sapiens
taggcccccttcttgcagattgaaaaacacatcctaaaactcatggagatgcaagggacccaggatagtcagaacaatcttgtgaaagaagaaagttggaggattcacacaccaccaacaacaataaaaaccagaagacagtgaaataatatcatcagaatgctaagagaatagtgttattccttattcagctatactattgttctcaaaagagggcaaattaaaagacattttccagcaaatactgagaggcatcaccatttatttatagagcattcatgaaa

SEQ ID NO: 10368 - DNA, 443 bp, Homo sapiens
tatatacatagatatcacatacttaaattcccggaagaggcccaattcccgttaaaccataaatatacacacacctcatatatatgtggcacacacactcgtatatcccacacacaacatatttaatgtgcctcatatataatatccctgggtgtgtgtgtgtgtgtgtgtgtgtgtgtgtatatatacatagaaaatacattagttcctctttatctgtgcaatcacattctgcagtttcaggtactgtggacaactgtggtgtaaaaatatgtgagtacagttcaatgagatattttgaaagaggccacactcacgtaacttttatgacagtatattgttataaatgttctcttttattagttattgttcatctcttactgcctctaatttatgaactttatcaaaagtgtgtacatataataaaatacatagtatataaa

SEQ ID NO: 10369 - DNA, 524 bp, Homo sapiens
atatcagtgattcgtctgcatacacttaaattggaacacttcagctatgaccttggtaaaaagatcagaggttgtccttgtttctaacttaagtttaattcgttcatctctgatttttcactcttgttaatgacatgtccaactttctaaactgattcttccaaaaggacaattttatgaatctttagaacctgaatgaaatgagtgttagctcataagtattttctttgctgctgcttgtccccatttctgccttccctactccaggcaaaaatattagtttaatatttcctattccacttcttaatctttttgaaaaaataatactttgcatggagaaaaaagtgaaatagcatgaaagggtaaaaaatagtgtgaaagggtagaaaatcatttggaacagtcaaaaaaatatgggtatacagtaaaaagtaagttttcctccttcttttggcccccacacactccccatccaactcattttccctccacagaaacaacaaccacttggagagacctacttt

SEQ ID NO: 10370 - DNA, 498 bp, Homo sapiens
gagcacccatggacacaaatatgggaacaatacacactgtgggctactagagggtgaaggaaggtgggatgggttaaaaaaactacctatcagatactatgctcactatctgggtgatgagatccatactccaacctcagcatcacacaatatttccatgtaacaaatctgcacatgtacctcctgtatctaaaataaaagttgaaattgaaaaaaaaaattaagagcaaaaatatactctgactcatgaaaaaatataccttggatgtataaatttcagtttcttctcttggcaaattctattttatccctactactttattttccgtatgaatggtcctaggaatactagaaatgctaaaggcacacaaatatttttctgtaattaaaatgtgcaagactgttgtactgttgtaatgaaatccttttcaattataggcttacatacttatgttcaatgaagagaatgacaactaatataatctaatttatacctta

SEQ ID NO: 10371 - DNA, 450 bp, Homo sapiens
gaaaacactttactaggccagacccccaccccggaactatcactgtttgtattctctgcaaggtgttggttgtgaaatcaggcttccatcttgttttacatcctgagggcatggcttctaactccagtggcaaggctttgtttagcaatcctgccttaggggatgagccctctctggttccatatctgcatgtcttcctagccctgtctcttaaagggccccacccagtgactgggttttcttttgcctgtctgtgtatatactgtgtgtggtatctgtaaaaagagctctaattaatttggcctaaacaaagacaagcacttggatctaatattttttaaagggaagataaaaactgtgatacctttcagttcacgtgactttaatcattgagaaacaaaaacagccttaaggattattggtaaagagcagatgttgtcaaaatgtaaa

SEQ ID NO: 10372 - DNA, 1330 bp, Homo sapiens
tggctggcgccggatccgcgagcagcagtgtccacctcacgtagctggccgaggcggtatccagattccgggggtctcgctccttggcatagtggtcgcttaactccagcgccttcccagtgcctcccaaacctctcctcctcctgcccggggctgttctaggaggagcctaaatgtccgcttccccagctgaaggggattgtggtgcgtaaacaggattaactccctcgcccccagctgcgcggatctgcgcggcggcctgcgggccagagcgagccttcgggtgcgtggagggcgcagcactggagcgggggatggggaagcgcgcggccttggagccgtctcttgggcccgcttcctcgccgagtggggaggggggccacagcctaaggagctgctcctcaaaagcccgggcggacggcggcgacggcgcgggttcctagcggcagcctcagctccaccacctccctcaccctccccgcgcttcctctccgcccctcgcgctccagccactcggccgcagccggcgctgtcctccgccccccggagccgccgcgccagaccctcgcccagacatgggggacctgccgggcctcgtgcgcctctccatcgcgctgcgcatccagcctaatgacggcccggtcttttacaaggtggacgggcagcgcttcggccagaaccgcaccatcaagctgctcaccggctcctcctacaaggttgaggtgaagattaaacccagcacgctgcaggtcgagtgagtgcggggcgcctggtggcagcagggtcccccatggggtacaggcagaggactgaggcccccaggacagcccgagcctctcaagggcctctggcctcgcgccgctcccagcgggcccgggggttggaggaagaggtcactccctgtccgccttcgtccccttccttccctttggcttgtattcctccattctcgcttccctccacccatcgcagtgacctcagtgggttctttaaaatcagtgacaagaagccagggtttttgcttgtctgtttcttataaatttctcctgccttctgtccagccttgggcgcggaaccgcaggcggtcggggtggagcagatgggagaggtccgcagggttcacccaccgcaatcccagccctcctgcgcgcggtccaggcggcccaccgggtctgcccgcaaggctgaaggagggagaaaggaggaatgaggtggaaaggcaggggaggggtgattactggggctccctgagggatgctccccactcccttcgccattcagtggctgggaccctggggtggagcagcagacactagtaagagagcggccg

SEQ ID NO: 10373 - DNA, 1922 bp, Homo sapiens
tggctggcgccggatccgcgagcagcagtgtccacctcacgtagctggccgaggcggtatccagattccgggggtctcgctccttggcatagtggtcgcttaactccagcgccttcccagtgcctcccaaacctctcctcctcctgcccggggctgttctaggaggagcctaaatgtccgcttccccagctgaaggggattgtggtgcgtaaacaggattaactccctcgcccccagctgcgcggatctgcgcggcggcctgcgggccagagcgagccttcgggtgcgtggagggcgcagcactggagcgggggatggggaagcgcgcggccttggagccgtctcttgggcccgcttcctcgccgagtggggaggggggccacagcctaaggagctgctcctcaaaagcccgggcggacggcggcgacggcgcgggttcctagcggcagcctcagctccaccacctccctcaccctccccgcgcttcctctccgcccctcgcgctccagccactcggccgcagccggcgctgtcctccgccccccggagccgccgcgccagaccctcgcccagacatgggggacctgccgggcctcgtgcgcctctccatcgcgctgcgcatccagcctaatgacggcccggtcttttacaaggtggacgggcagcgcttcggccagaaccgcaccatcaagctgctcaccggctcctcctacaaggttgaggtgaagattaaacccagcacgctgcaggtcgagaatatttccattggtggtgtgcttgtcccactggaactgaagtctaaagagcctgatggggacagagttgtttatacgggtacatatgacacagaaggtgtgaccccaacgaagagtggagaacggcaacccatccagatcaccatgccgttcacagacattgggaccttcgagacagtgtggcaagtcaagttctacaattaccacaagcgggatcactgccagtggggaagccccttctctgtcattgagtatgaatgcaagcccaacgagacacgcagtctgatgtgggtgaacaaggagtccttcctctgaaagtggctctttctgatgctactggacaatcttttcagaaatctacttttagataaaccagcgcaggccttaaacaaggcatgccacaccattgctgttccccatctggtactaatgacctactagccctggttattttgaaagtgtaattcccctctgacacaatatccctcacatacaagatggtgatgtaccactcccgagaatattcccatctgtattttgtgctgatgttcctgcatccagttgttctcggtcatacttttgaccacttgtgactggagttcagtggccctggcaggcttgtcctgctcttgaccattccactgactaactttggtgttttgtttccaagttaagtgattcctccttttttttgttcaatgttaaatttaaaaataacaatgtgtatgggtcctcccatgtgtaatatggtaacatgtaacttgcagtgtttgccagctttcaaagcaggctttgtgaaaatgtaatacaaacagcagtgaatgggactcaaatgttgtgcttcctataaacagctccgctctttcagggaaggatggtaacaaactagaaggacaaatatgtacgtatttataacgtattaaaactcttttaagtagcttaaggtattgtgcaatggcctagcctagtagaaatgggggaaaagcattgctgtggaccattgttaaagtgacaggagttgtagggttacccctttgacaagcttccatagtcttcagacacgcacattgatggcatccctacagtcttcttcacttgaactttgtaaaactgcatatggacctgtaatcaacttttgatatttcttaataaaggcgttgaaaatca

SEQ ID NO: 10374 - DNA, 1890 bp, Homo sapiens
tggctggcgccggatccgcgagcagcagtgtccacctcacgtagctggccgaggcggtatccagattccgggggtctcgctccttggcatagtggtcgcttaactccagcgccttcccagtgcctcccaaacctctcctcctcctgcccggggctgttctaggaggagcctaaatgtccgcttccccagctgaaggggattgtggtgcgtaaacaggattaactccctcgcccccagctgcgcggatctgcgcggcggcctgcgggccagagcgagccttcgggtgcgtggagggcgcagcactggagcgggggatggggaagcgcgcggccttggagccgtctcttgggcccgcttcctcgccgagtggggaggggggccacagcctaaggagctgctcctcaaaagcccgggcggacggcggcgacggcgcgggttcctagcggcagcctcagctccaccacctccctcaccctccccgcgcttcctctccgcccctcgcgctccagccactcggccgcagccggcgctgtcctccgccccccggagccgccgcgccagaccctcgcccagacatgggggacctgccgggcctcgtgcgcctctccatcgcgctgcgcatccagcctaatgacggcccggtcttttacaaggtggacgggcagcgcttcggccagaaccgcaccatcaagctgctcaccggctcctcctacaaggttgaggaatatttccattggtggtgtgcttgtcccactggaactgaagtctaaagagcctgatggggacagagttgtttatacgggtacatatgacacagaaggtgtgaccccaacgaagagtggagaacggcaacccatccagatcaccatgccgttcacagacattgggaccttcgagacagtgtggcaagtcaagttctacaattaccacaagcgggatcactgccagtggggaagccccttctctgtcattgagtatgaatgcaagcccaacgagacacgcagtctgatgtgggtgaacaaggagtccttcctctgaaagtggctctttctgatgctactggacaatcttttcagaaatctacttttagataaaccagcgcaggccttaaacaaggcatgccacaccattgctgttccccatctggtactaatgacctactagccctggttattttgaaagtgtaattcccctctgacacaatatccctcacatacaagatggtgatgtaccactcccgagaatattcccatctgtattttgtgctgatgttcctgcatccagttgttctcggtcatacttttgaccacttgtgactggagttcagtggccctggcaggcttgtcctgctcttgaccattccactgactaactttggtgttttgtttccaagttaagtgattcctccttttttttgttcaatgttaaatttaaaaataacaatgtgtatgggtcctcccatgtgtaatatggtaacatgtaacttgcagtgtttgccagctttcaaagcaggctttgtgaaaatgtaatacaaacagcagtgaatgggactcaaatgttgtgcttcctataaacagctccgctctttcagggaaggatggtaacaaactagaaggacaaatatgtacgtatttataacgtattaaaactcttttaagtagcttaaggtattgtgcaatggcctagcctagtagaaatgggggaaaagcattgctgtggaccattgttaaagtgacaggagttgtagggttacccctttgacaagcttccatagtcttcagacacgcacattgatggcatccctacagtcttcttcacttgaactttgtaaaactgcatatggacctgtaatcaacttttgatatttcttaataaaggcgttgaaaatca

SEQ ID NO: 10375 - DNA, 1221 bp, Homo sapiens
tggctggcgccggatccgcgagcagcagtgtccacctcacgtagctggccgaggcggtatccagattccgggggtctcgctccttggcatagtggtcgcttaactccagcgccttcccagtgcctcccaaacctctcctcctcctgcccggggctgttctaggaggagcctaaatgtccgcttccccagctgaaggggattgtggtgcgtaaacaggattaactccctcgcccccagctgcgcggatctgcgcggcggcctgcgggccagagcgagccttcgggtgcgtggagggcgcagcactggagcgggggatggggaagcgcgcggccttggagccgtctcttgggcccgcttcctcgccgagtggggaggggggccacagcctaaggagctgctcctcaaaagcccgggcggacggcggcgacggcgcgggttcctagcggcagcctcagctccaccacctccctcaccctccccgcgcttcctctccgcccctcgcgctccagccactcggccgcagccggcgctgtcctccgccccccggagccgccgcgccagaccctcgcccagacatgggggacctgccgggcctcgtgcgcctctccatcgcgctgcgcatccagcctaatgacggcccggtcttttacaaggtggacgggcagcgcttcggccagaaccgcaccatcaagctgctcaccggctcctcctacaaggttgaggtgaagattaaacccagcacgctgcaggtcgagaatatttccattggtggtgtgcttgtcccactggaactgaagtctaaagagcctgatggggacagagttgtttatacgggtacatatgacacagaaggtgtgaccccaacgaagagtggagaacggcaacccatccagatcaccatgccggagtgcctggaacaacgaccccaagagatctctcttacatatgaatgtgaagaataagcacattcttcaatgtgtgccatcatgaggaacaaatgttctttttttttttttccaaattatttgctttgcattctaggggagggcttctcacaggccatcagaattatcggggatgcttgttaaaatgtagattcctaaactctacctttttagacctcttaaattgagcaaactctctgagagtaaatccaaagcatctgcattttattaagcactttaggtgattcttatcatattaaagtttggaaaacactac

SEQ ID NO: 10376 - DNA, 4740 bp, Homo sapiens
cccagatagtcacatttaaaggttgctagtttgaaatttgcaaatgcttccctgctgtcagagttaggtttcctacagctgtaagatagctgctactcaacctacagcagatgcccgtgacattgtgtgttcctgggtgtatctcccatctagcaactccaaactgtgtatgctgtagtttgtgttcctggaactactatcttcaggagaagcttcagttataaatagtaattggagtgaagagatgagttctgtttaggggagatccattaactttcaacaagggaggacagggactttttcaataggaattgcaataacatggtttgtttttgaaaatgcaatagactgtggattaaatagctattgcacacaaagaagaaaataaagttataatctccagcatgagatctggatttacatatgctctgttagctgcaagaatttgggcaagctatttaatttccataaatttaggtatccttaagatacccactgcttagagttattgtgagaattaattgaggtaagaaaactgaggctcaggttgtcatttgctcaaatcacacagcaaaaccgtgatagaatgcagattcaaactgggatattaacattccaaagcctttacagttattgactactattcagcactgccttcaatatatgctgatgactgcacacaggagttagaaatgcccactgtcacttgcctgccttgagcggtttcttgtttgtataaataatccaaaatacttggttgtgttgtaagaagcaccgtgttttgtgagacatttcaaaggtaccacaaataggaaagatttcattctagaatgaatagagcacatatttagtatctacgtgctgtttggttaattttagttatttggtcatgcttttaaaatctatttttatagtatatattttcttttatagcatatcagaattatctttagattcaactcttcatgccgtcaatcttcattgcaataacatctccaagatcgaagccattgatcatatttggaatttacaacatctagatctgtcatctaatcaaataagtagaattgaaggactaaacacactgacaaaactgtgcacattaaatttgtcctgcaatttgattacaaaagtagaaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacgttgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggttttataaatattgtctgttcctgaagaggaacaccactgttccaccttcattctcccttctaataactgtatatgaagaaattctgataatgtaactggaagcagtaattcatttcattccataccaggtcattactgtattactgtttcacttttgtcacatcatatgctagtatgcagaacaaaagtcttaagtactatgcccctcttctatttctgaaaggaagaaaatatatattttcttgatatca

SEQ ID NO: 10377 - DNA, 643 bp, Homo sapiens
tttttgtatgtaaggatttaatgattacatgctgcagaagttgaataagtaacaagtttattatttgctttctggaactattccgggtgatgtatctggtagctgataaatttagtttattctagaaataattgactttttttaatatttcagttttcattttgaatgatttgtttccaagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaaaaccctctggccaatttttggccttga

SEQ ID NO: 10378 - DNA, 1104 bp, Homo sapiens
tgtcttttaaaggcatcatccatactatgaagtgaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacgttgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggttttataaatattgtctgttcctgaagaggaacaccactgttccaccttcattctcccttctaataactgtatatgaagaaattctgataatgtaactggaagcagtaattcatttcattccataccaggtcattactgtattactgtttcacttttgtcacatcatatgctagtatgcagaacaaaagtcttaagtactatgcccctcttctatttctgaaaggaagaaaatatatattttcttgatatca

SEQ ID NO: 10379 - DNA, 3548 bp, Homo sapiens
tttttgtatgtaaggatttaatgattacatgctgcagaagttgaataagtaacaagtttattatttgctttctggaactattccgggtgatgtatctggtagctgataaatttagtttattctagaaataattgactttttttaatatttcagttttcattttgaatgatttgtttccaagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacgttgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggttttataaatattgtctgttcctgaagaggaacaccactgttccaccttcattctcccttctaataactgtatatgaagaaattctgataatgtaactggaagcagtaattcatttcattccataccaggtcattactgtattactgtttcacttttgtcacatcatatgctagtatgcagaacaaaagtcttaagtactatgcccctcttctatttctgaaaggaagaaaatatatattttcttgatatca

SEQ ID NO: 10380 - DNA, 3896 bp, Homo sapiens
acagttgggacgaggattccagttttgcgtcaccgtcaaggcgggaaagttcccggctgtcggttggagggtgggtcctcgccccgccccgccccctcgggccgcccttccgcgcttccgggaggcttgtcccaagctcacggacccctcgctgggtgccggttaagaccccgctccccgtcgccagtgctatggaggcggcggcggcggtggtggcggcagaggcggaagtggaaaacgaagacggcgacagcagctgcggggatgtatgcttcatggacaaaggcttgcagaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacgttgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggttttataaatattgtctgttcctgaagaggaacaccactgttccaccttcattctcccttctaataactgtatatgaagaaattctgataatgtaactggaagcagtaattcatttcattccataccaggtcattactgtattactgtttcacttttgtcacatcatatgctagtatgcagaacaaaagtcttaagtactatgcccctcttctatttctgaaaggaagaaaatatatattttcttgatatca

SEQ ID NO: 10381 - DNA, 4102 bp, Homo sapiens
acagttgggacgaggattccagttttgcgtcaccgtcaaggcgggaaagttcccggctgtcggttggagggtgggtcctcgccccgccccgccccctcgggccgcccttccgcgcttccgggaggcttgtcccaagctcacggacccctcgctgggtgccggttaagaccccgctccccgtcgccagtgctatggaggcggcggcggcggtggtggcggcagaggcggaagtggaaaacgaagacggcgacagcagctgcggggatgtatgcttcatggacaaaggcttgcagagcatatcagaattatctttagattcaactcttcatgccgtcaatcttcattgcaataacatctccaagatcgaagccattgatcatatttggaatttacaacatctagatctgtcatctaatcaaataagtagaattgaaggactaaacacactgacaaaactgtgcacattaaatttgtcctgcaatttgattacaaaagtagaaggacttgaagaactaattaatctgactagactaaatgtatcttataaccacatagatgatcttagtggattgattccccttcatggaattaagcataaacttagatatattgatctacatagtaatcgtatagatagtatccatcacttacttcagtgtatggtaggattgcacttcctgaccaatcttattttggagaaagatggagacgataatcctgtctgtcgactgccagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacgttgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggttttataaatattgtctgttcctgaagaggaacaccactgttccaccttcattctcccttctaataactgtatatgaagaaattctgataatgtaactggaagcagtaattcatttcattccataccaggtcattactgtattactgtttcacttttgtcacatcatatgctagtatgcagaacaaaagtcttaagtactatgcccctcttctatttctgaaaggaagaaaatatatattttcttgatatca

SEQ ID NO: 10382 - DNA, 1626 bp, Homo sapiens
aaggaaacttccttagtttgggcgacaagagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagattgtttacaagaaaaagatgaacacatcaaaagattacaagaaaagatcacagaaatagaaaaatgcactcaagaacaacttgatgaaaaatcttcacaactggatgaggtacttgagaagttggaaaggcacaatgaaagaaaagaaaaactaaaacaacagttgaaaggaaaggaagtagaacttgaagaaatcagaaaagcttacagtacactgaatcggaagtggcatgataaaggagaacttctatgtcatcttgaaacacaagtaaaagaagtgaaagaaaaatttgaaaacaaggaaaagaaacttaaagcggaaagagacaaaagtattgaactacaaaagaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacgttgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggttttataaatattgtctgttcctgaagaggaacaccactgttccaccttcattctcccttctaataactgtatatgaagaaattctgataatgtaactggaagcagtaattcatttcattccataccaggtcattactgtattactgtttcacttttgtcacatcatatgctagtatgcagaacaaaagtcttaagtactatgcccctcttctatttctgaaaggaagaaaatatatattttcttgatatca

SEQ ID NO: 10383 - DNA, 2294 bp, Homo sapiens
tttttgtatgtaaggatttaatgattacatgctgcagaagttgaataagtaacaagtttattatttgctttctggaactattccgggtgatgtatctggtagctgataaatttagtttattctagaaataattgactttttttaatatttcagttttcattttgaatgatttgtttccaagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaagttgtaatcgtaaaatgaaaccaccttaccttaaagaattatatgtaagctcatctttagcaaactgtcctatgttacaagaatcagaaaagccaaagactgaaataattaaagtagaccaaagtcactcagaagacaacacttaccagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggaaggaacttgaaacaagggagttttttactgatgctgacttccaggatgccttagctaaagaaatagccaaagaagagaaaaagcatgagcaaatgataaaagaataccaagagaaaattgacgtgttaagccagcagtatatggatttagaaaatgaattccgtattgctttaactgttgaagccagaagatttcaagatgttaaagatggttttgaaaatgttgcaactgagttagcaaagagcaaacatgctcttatttgggctcaacgaaaagaaaatgagtcttcctctttaattaaagatctgacctgtatggtaaaggaacaaaaaacaaaactggcagaagtttctaaattgaaacaagaaacagcagcaaatttacagaatcaaatcaacacccttgaaattttaattgaagatgacaagcagaagagtattcaaatagaacttctcaagcacgaaaaagtccagcttatttctgagctagcagccaaggaatcactaatatttggtttaaggacagaaagaaaagtatggggacatgagctggcacaacaaggatcttctctagcccaaaatcgtggaaaattggaggctcaaattgagagtttatctagagagaatgaatgtctgcgaaagacaaatgaaagtgatagtgatgcattaagaataaagtgcaaaatcatagacgaccaaactgaaactattagaaaattaaaagatgttcagaaaaagatgacccttcaagattcgaaaagatccaaaaaaaaaaaaaaaaaatttgggggtggccgaaagttttaacttcgtggggggcggatagaaagggaggtcagaaacggggaagggggtcccaaaaaggggggggtgaaacgggggggggtcag

SEQ ID NO: 10384 - DNA, 812 bp, Homo sapiens
tttttgtatgtaaggatttaatgattacatgctgcagaagttgaataagtaacaagtttattatttgctttctggaactattccgggtgatgtatctggtagctgataaatttagtttattctagaaataattgactttttttaatatttcagttttcattttgaatgatttgtttccaagggtacagagcagttattctccagactttgccacagcttagaatcctagattgcaagaacatatttggtgaaccagtaaatttgacagaaataaattcatcacagctgcagtgcctagaaggtcttttggataatttagtttcttctgattctcccctaaatataagtgaagatgagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaaacttctaattcaatagataacgttcttgagaaagaccccagaccaaaaagagacacagatataacttctgaaagtgactatggaaacagaaaagaatgcaatagaaaagttcctcgaagatcaaaaatcccttatgatgccaaaaccattcaaactattaagcaccacaataaaaactacaactcttttgtaaggtggtttcattttacgattacaacttacaaaagagttgtagtttttattcg

SEQ ID NO: 10385 - DNA, 398 bp, Homo sapiens
gccttttctctctctctctttacaaaactcaattaaaatgtgcatgtgcagtaatcttccctttcagagcgcctgtggtgattgatagagttgtttctaagtatgtttaggctcagtggaatcacttaacccattgtgggacatgcagaaatgggcaaagaaaaagaggccataaaaattatacagccagaggaggctgataatatccagaagaaaggagatacagaaagagaattgaacacatgacatataagaatgagaagggatggaaatgcatcctctatgaattgttcattgtgcccattttcaaagtgaagaaacttctagaatatgggtgaggcacagttttcgatacaaagctcattgcgtgtttaccaatgtgaaggttaattgggagg

SEQ ID NO: 10386 - DNA, 493 bp, Homo sapiens
tctaatagcttctcttccaagagaccttttttaaccagttgaactccagtaatgcccccttctctgaacggataatacttattatctttaccacttattaatcttacttcacagtttctctcataatattatttccatgagtaaactgtaagacttgaagggaagaactgtggcttatactaatttttatagtagtgtaaatgcaaaatatgtaataaacccacaataaacatagtactgtatggaaggatgaaaaaaaagatggacaagtggatgggaagggtgaccaggatcaggtcaagttacaccttgtggcatcaatggtatgttatcgcttcattaactaatatttattgggcatctactgtatacaaatactgtgctgtaatctatgagggataaaagagaaggggaaaatactgcttttgttcacaatatagataggaagacaaaacaaaagccaaacaaaccaaaagaaacaataccaacatgg

SEQ ID NO: 10387 - DNA, 549 bp, Homo sapiens
cagagccctgccaccgactcatccgaggagtccttcagcagatccccacggagaggtacggaatcgactgcatcatgaatgatgaatggatgcaaggggtgccataccctacacctttggaacctttccaactggatcccaaacatttgtcggaaaccagcactctcaaggaagaagaaaatgaggtcaaaagcactttagaacatttgggcattacagaagagcatattcgaaataaccaagggagagatgctcgcagctcaatcacaggggtctatagaattattttacatagagtccaaaggaagaaggctttggaaagtgtcccagtcatgatgctaccagaccctaaagaaagagacctcaaaaaagggtcccgtgtctacagagggataagacacacatccaaattttgctcgattttataaattgcactagactgcttgtaactaaccaagatgattgttgctgcttctaaatttttttcaaggacaacttgagtggagacatttttgtaatttttaaataaacttaaatttgagatatgca

SEQ ID NO: 10388 - DNA, 445 bp, Homo sapiens
gaactctactactttatgaatctacagatgcaataaagcgaggaaagctgaaggctggctctgcagcaaaaatgatactcatggtcaataagcctgtgatcaactacaggtgcttactatgtgccaagacctttgcttggtgcttctcatgcagaatattatttaactgccacaaaagtcctatagtatacgtatgatatcaccgttttgcaaattgtgagtctgtaactatgagaggtagagtgacttcctcaagctggtgtttaatcctgtatcagtcaatataagaaacaggctgcttaaagtcaatgcagtgcttttactttatcacacaaaagctccttttaaatatgagaaattataggaatttatttatcttccctccctggtataaataaataccatggtataagtaataaataaatgcaaatattctggctctaaa

SEQ ID NO: 10389 - DNA, 472 bp, Homo sapiens
ttccaaaactgaccctgtcaacttcagcaattttattgcacaaattaagctgtcatccatgggattagaaaagagggcattcgggcattcggcaactcctcaagaccaacctgaagaatatctgcccttgtaacctgtccatttgttcctctgatctccaggttatgataaagctctcccagaaagggtacaaatgcatgaaattgttttggagtaacttcatccccttttgcagcttgatctttaatgtcatatttcagtccgacatctttgaagtagaaattggcggaaggtgctactctctgtgctaactgtcagatgatgtcaggtaattacacaggtgagctcccattgtaagagaaatttggggctgggcacggtggctcacgcctataatcccagcactttggaaggccgaggcgggtggatcacaaggtcaggagatcgagaccatcctggctaacatggtgaa

SEQ ID NO: 10390 - DNA, 761 bp, Homo sapiens
cctgtctcaaaaaaaaaattacatataagcccggtttaaagagaggataatatgcaaccaccctagttgaaacagagtgtatcacttctttctcaccctaaatttaatgcctagtttgaaaatcagtagacaataataaagttgataagctttaggttggtaggaaagctatgtaatctatatagtgtactaaatccttatatgtttttggtaaaaaaagactttaatagctaatttggacttcagaaaatgggttaatttcacgagtgcatatcacttttgactatattagtcaagcatattattaaagtttaaaaaactctaaaacttctgtactgtttttttcttaagtgctctcttccttatttctacattactacattcacatttctgctgtcaataagccctaatggagtgataaactttaagctagtagatactgcaccatgtcttgtggtggtgttttcttaatgaaatggaagctgtacttcctgtttgtttttaaatacttttgaaacagacagttcatgtaccccatcatttagagatgcagtttgaatttccatggaaaaaggtgccaattttggattgggaaaggagctgaagccccagtcaagactttgccatttggggtaatgcagcagattcctgtgtctgtatctttccagtgtgtgtgttaatccatagtgttctgagcaccagaagggtcatgtaaatctgaagttgttattaaaggtttttctatagtgaaaaaaaaattt

SEQ ID NO: 10391 - DNA, 231 bp, Homo sapiens
tgagtaaatatggtaatgacctggttttattttcttgtgggaaactgtcacccaactggcatgactggaagacacatctcttacagaacagtgttttttctaaggatttgcattgaccacttgagagtgattaatatttacttcattttttacctttcctcctatcaccatctgtagaaaaatctgataagcagagtaaagaaataaaaagttaagaaaaagcatttactt

SEQ ID NO: 10392 - DNA, 467 bp, Homo sapiens
aaagacgtcagtgatgcactcattagactgcaaatgaaatatgtttgtacaagatataattgagtttgatatgaaaatattaggagaaaaatattaacatttaagtagttaaatagtttatcaaaatctagttaaccagttgtttaatcacagtagggaaaaagtaaattagggaattgtgatcaagaaggtagtgttttggttgggtgtggtagctcacagctataattggagtactttgggaagccgaggcaggaggttctgttgtggccaggagttcaagatcagcctgggcagcatagcaagacccatctctacaaaaaaaaaaagttagctgggtatggtggctcacacctatagtcttagctactagggaggatgaaacaggattgcttaagttcaggagttcaaggttgtagtgagctaaggagtgccagtgcactccagcctgggtgacaagaacagta

SEQ ID NO: 10393 - DNA, 900 bp, Homo sapiens
ggacccctcatagctctagttctgctggatagttggttcattactggtttactctctggaggtgtgtagccttttgggttcttgcttactgtagtggggttttgggttatatgttttggaggacccagtcttttattcctgtctccccctctctgcactgtcttaaaaatgaaagttgagacttttcagaattggcaagtgcactgagggcagaggtagtttctgtgcttatctctttgacttcctggtttcacttcaatttttgcctgttatttatttcttgtcttgtcaggttgtggttgcttttaagattataaaaatattctgtccatattttcttttagtctttttcagaaggagggttggaccaaataacattgcttgaaattaagaagccaaaacgcgttcttttttatttcactccagagtctagacctgaacctgatgtttgatatggtaactgctagccacatgtggccaattaaattgaaattaattacagttaagcgaagttgaaaggcccattcctcagttacactagtcccatttcaagtgctcattagccacatgtggctagtggctactacattgggcagcgctggtatagaacattttcatcattgcagaaagttctagtggatagatatggcttgactatcaaaacctcatcagggacttgcactggtacgtggatctgcatttgaaaaccactaatatgggtatccttgctgtttaaagtttgaattttttggaatctatatagctagacagatgattgagttcctttaatagacttactgtgaaatctatccctaaggtacagtgtagattcttagactgatttaggtggtgaaatgtgaatctgtggcacactgagtagataactattaagtattgata

SEQ ID NO: 10394 - DNA, 556 bp, Homo sapiens
atcatggcacaagctgcagtttccaccctgcccattgaagatgaggagtccatggaagatgaggagtccgttgaagatgagtctgttgaagatgagtccgcagagaacaggatggtggtgacattgctcatatcagctcttgagtccatggatcatggcacaagttgcagtttccactctgcccattgaagatgaggagtttgttgaagatgaggagtccttggagagcaggatggtggtgacattcctaatgtcagctctcgagtccacggtcagaccttctgttctcacattctgtagtttggtaggactgggcagtagataaggttgacttatttttgtagaacttacaattttatgattttcagttgtaatgagtagacctttttcgtgaatagtagttatggttaaacacctctaaccaaatgtgcatgtggagtttctacactgattttcagacaatctggatcccaactgggtatcccacaattccatcctgacactccctggagttagtgcagaccccgcaggatgggggctcagtcccaggagtgta

SEQ ID NO: 10395 - DNA, 410 bp, Homo sapiens
atatactcaatcccttcccttgatgggttagactctacagcctctgtggcaacagcccacagtgggtactcacgaatgtctactgtgtcctgctgcagctggtccagaagccacccccagaattagaatttaagcatgaaaaaatgcccagggaaatctgtgacttgttgctaaatcctaaacacagtttgtgtatccagtgctcagcagagggcttagcacatgacaggtgctcaagaaaacacctgctaatacaagggcacaatcaacacagaaacatttctaaatgtccaaaatcttttttgtaccaaagcaaaatcaaaaccaaaacaaacaaataacaacaaaaaacctcgggcagtttgttttcctgaatatttaaccaaggaagtatatcccagccctgaggg

SEQ ID NO: 10396 - DNA, 409 bp, Homo sapiens
cctgggccaagtgatcaaagctaactgcaccagggacgtcttgtggatattgggtacctctgatgcgaagagaagggcactttcccctgtgatatgtatccaaaaatccataagcccagaataattgtaagagagcatcagacaaacataaactgagggacattctacaaaatatctgataagtacccgtcaaaagtgtgaagatcgtgaaaagcaaggaaagactgaggatctatcacagattggaggagactgaatagagatgacaactaattgtatgtgagatcctggattatatcctgcaacagaaaaaggacagtagtagaaaaagtagtagaaactgaacatagtctctaatttagttcatagtgttgtgccaatgttaacttcttagtttcaataaaaaaaa

SEQ ID NO: 10397 - DNA, 3031 bp, Homo sapiens
  misc_feature (2777)..(2777): n is a, c, g, or t
  misc_feature (2827)..(2828): n is a, c, g, or t
  misc_feature (2875)..(2876): n is a, c, g, or t
  misc_feature (2881)..(2881): n is a, c, g, or t
  misc_feature (2888)..(2888): n is a, c, g, or t
  misc_feature (2903)..(2903): n is a, c, g, or t
  misc_feature (2907)..(2907): n is a, c, g, or t
  misc_feature (2913)..(2913): n is a, c, g, or t
  misc_feature (2919)..(2919): n is a, c, g, or t
  misc_feature (2923)..(2923): n is a, c, g, or t
  misc_feature (2940)..(2940): n is a, c, g, or t
  misc_feature (2979)..(2979): n is a, c, g, or t
  misc_feature (2984)..(2984): n is a, c, g, or t
atttagatgtcgggggcgggggagggtggttggcggcgggagttgctgagagggccggccgcttatccctgtttggtcccacttttctcccagcacctgcccttgttcaccgcctcttcatctacttggatttggctcgaataaaccctcagctcccggccagcgctgagagccctggcggaagagtgggtagcggtggccttaagtattaaatctgagcctgcttcttgggggagagactcgttgaaaagggagtgtgttgggggggtgttgtgcgctgaggggagttagaacttcccggtcggttacccagtgggaagctgcggggcacaaagcccagaatttgctgctaatcgctgggtgccctggagacagagggggcgtgtcctctgcggattccattctcaccttcccctcccgcttctgatctcgctgtttgctccacccttgctccccacccactatcagctccagcgggtgggggtgaagggctgtccccaggccaacacctccttccaggctttggggagtggggattctttccccggatgggcagagttccttctgcagtggcgctaccgtccgtgctgccctcctggaaacaccggggtttggggcaggaacacttcacctgaaagcaggcctgcttggcgcctcccggcacatctgtggtctcctctgcacgtcgctcgcgcagcctccttgcctggaatgtccttcgctgcccatcctcataggcccacctgggagagatcatatccatgccccctgccccaggtttgtgggtcaaggactggcactgtctggtgctgtagcactggggcacaggccacccccctgcccccaggccctgcttttcgtgcaacccccaggcacataatggccacccagctaaggctctacaagcgtaagcctgagcctcccaggtggacaaggacagaagtcacctgggggctcactcctggtctcatcggagaaacctaggcccagagaggtgggggtactaaagcaaagtcacaccacatgctcctctgatggccagggtgagcctgcagtcctctcctctcccccttactccagggtgctggggtggcccctcaggacagtgaactgactgtgtcccaggctccaggtccctggcacagctggggtcacactgacagcctgcccagaggcaccccaccttgggacccgtaccccagcagcccctgcctggctccttcttggggtgcccccaacctacaggctcagggcagataatgccagtgcttctccttggtggctggggagggggactgtccaccccctactattcgcctagtgtgggtcacgtgttttaacttctcagggaggcggggccagcatcttgactgacagcatccttgaggccttgcatggtggaaggtttggaatgcctccccctctcccctactgggggatcaacccaaatcttgaggccacatagacactgggctctggatggacagaagcaggcgcagagagaaaagctcagctaggggtgggagaacccgggaggagaggtaaccccaagagggaagggtgcctcttccactacctctgctaccagccatccccaggacagtggttcctccccaccccgcccagccctgaggactactggttggggattgcctccggagcccagcttagggaggacagtagacagtaggctttggagttgggagacagggttccgcttctgctggtgtgactggaggcctcctcgtgcgctcagaaaggtggtgaggaggctcctccaatggaggccggccccacagcccacactgttcctgaggatgggttcttctgggtgaaggagaccaagcccctcgccgaagggtgctgaaacaagtcagaagagaaagtgggaaccagtgcctctcctgggagacttgagtggggccttgtgggagtggggcctcccaacagaggcaagtggcgtaagggtctttctgctctctccctcccacgccttgctgctgttgctgtcacctgggcaggtctggggccagaggcgtgaccatgcacccacaggaaggggaccccacagctggacctagcttcaagggacatggaggggcctcgaggggccccctgctggagggagaagtaaagtccagtggcacatcctgggcaagtgttcagtttccaaaaccgagggaaatccagatacttcccaagaaaagaggttctagaacgaggattttcagctttagaaaattaaaaagctgaagtggaaaagaggatggatttcctgtttccaggatgcaaaggcctcccagaaaatcagaaacccaaatggaagtcatgaaagaaaagataggcttggtggttgcttcttcattcacctgtgaatgttagaggctctggaagaagaaggaacaggtctggagatgattaatatgatgaataaataatagtggaaattttccctgatcagaagagggcatgagtctgcacagtgaaagtgttggtagagctccaggcagggttactttaaagaaaaagacacacccttggcatctcctggtgacattcttgaaatccacagataaaatctcagcgacctcccacagaataaataaaccattgacaaaggagaaaaaaaaaaaaacattggcagcagatttctcatctgcagcactgaaagccagaggaccaaggctggcctgggcccaggattctcaaccagagcattcatactgttccccaaccagattaagaaatagattttgagccgggctcagtggcttacncctgtaatcccagcacttcgggaggctgagatgggtggatcacgaggtcnngagatcgagaccctcctggccaacatggtgaaaccccatttctaaanntatanaaattanctgggtgtggtggcncgcncctgtngtcccngctncacaggaggctgaggcnggagaatcacttaaacccgggagacagaggttgcagtgngccgngatcgcgccattgcactccggcctgggtgacagagcaagactatctc

SEQ ID NO: 10398 - DNA, 479 bp, Homo sapiens
cactactctcctctttcccagtcccacctcaaaacctcaaggccaactttgtcactctgtccttctagctctcataaaacccccaatcacagaagattaggggtggaggaggaagtgtgggccagaatcatggccccagagctcgagcctccagttgtctgtcaatcctggtcaagtctctgagctccatgtggaccacctgcagcccaggtcggccagggccttccagccagcacagtctccatgtgagtctgcctgaccaggtgtatcaagtgcacaaagatgggatgcatccttagagagaaaactctgacacctcctattctacctttgttaggaaatgaaccatgacataacaagatcatagcaaaggagaaaaacaaatggttaataaatatatattttatcaatataaatcaaagaaatgcagactaaacaatgatgtactgagtagacaaatattaaaagttattttaata

SEQ ID NO: 10399 - DNA, 305 bp, Homo sapiens
aattctgggtctcttcattaaatctcatcttgttggtaaggtgctccctgaccattctacataatacaaaacaacctgcctgccccacttctccccagcctctctgtcttgctatgcctttctccagagccggatccccatcttggtggctacctagttactgtttacctgttagctgcctggcttctccctactacaacgtaagctccgtgtgcactgctatttggttcactgctgtgtccccagtgcctagaacagtgcttggcacataaaaggcattaaatgactcttcgtgaaataaataa

SEQ ID NO: 10400 - DNA, 2168 bp, Homo sapiens
ttctttccgtcctggcttccctgcccccactgctcaccctcgcgtccaggaattgcccgccttggggagggaccgaggggcggggcggatgtcaccccatgggaagcgggccgacggccaagcgcaggggcagctgaggctgccgccgagcacgccgcgcgcacctgaccgtggagggtgtgagccgagggcccctcgctcccaggagctccgctcctgggcacaacctgcgggcgggcgggcacccggttgcgcagccccctgggtgccccagtgtcacccccttcctcccggccagtcaagcgcagaaagataccgggcgctgtgcccggcgctccctccctcctctgccccctccggagcagaggcgccccggtcgcctcccctccggctgcagcgttacacaaccgcggcggcggcgcctgccctgcagcagcgcagggcgtgacgcttcacgtggccgggctcaggtcgtagcaccgcggaccgcgagcctctctgcgttgacccagggactgagaccccggggacgtggcgtgccagcccggatcggccctctccctgcctgttgggaagttcggcggcgctgttcgcggtctgcacccagggcaggagggatgagagagacaagaaaaaaaaaccgcctgttacagggaaatcttagcaatcatgcggtcgacacgtatttcttgagccccctgctctgcactaggcgctgcactagttgatgaatccgacacggatcctgcccttgaacttgcagaacctctaggaagaggttaaattgagcaataaaggaaaggcagccctgggaaaattgtatcgaggccactggctgacagaggggaaaaacaatgagaacttgtgttgctttgtgttttgtttttaatttcattgtaaccgagatgcctaggtagagaagcgggggagaagctaacccaaagccccaagcccggggcggaaggacctcctccagcggccccagatctctgcaatctcacttaggctgccggagggccccacccacctcccccggaaaggtccgggctctgtgaccttctcactcagccgggagcagggaaaacagctgaaactccaatcccgcggtgtgagcagcgctgatacagtcagaggagggagccagtggaaactcatgactaaaataaggcctggctggggatttcactgacctctgcgctcccctgccctgcaagttcggggagttgagagatgactgtaagcccttcccactgcgcttcgggtcagtcaccccactgctgagtgacctggctgtgggaaggattgaaaaaaaaatggggtcactgccgagactgggcgaagagtagtagcctcgggtgcagttaggggatcagtcttaactggcagtgcccttgacgacctagagaactggcattcacaagttgaccaaactggcagtgtatttccttcaggtcgccttggagagctcccgcttcctgtttatatttcacaagcgtcaaactctttagcaagtgtgagaaatgcctccttttctaactgctaactggcatgtcctcacttcggggctcagagatccctccctgccagaatgtacttttgctggccaaaggcggggaccggggtccgccctggaaacgcgctttcaatcttgggcgacctgcttcattgtgtgattttaataaggatgaagggctgtcacggctgcgtcaaaaccacggttccagcaggaaataagcactgggagaggacaggacacgtacccccttccgccgacaccccccacccgatggcaggagggagcccaaaccttgcagcttccatggctcatggctcatgacaatatcattcttaaaattctttgagtttatcaatacgttttgcccttacctgccctacaactgtaaataacaaaatgtatgcatttcctactttttatttgttccgaatgtattctcaagcttcaagaacggttcccatcctaccagacttccaccgtatcaggattaaaaaacaaaacaaaactctgttattctctccatagcttatggcttttaaaaaataataatttgaacaaacaattcctacgtggcatagatctttccatcctggagaatgttactatttcagtctgtcatcttttgtagatattaaaaacctttcgtatgtca

SEQ ID NO: 10401 - DNA, 294 bp, Homo sapiens
  misc_feature (14)..(14): n is a, c, g, or t
  misc_feature (84)..(84): n is a, c, g, or t
ataaaggcaaatcntaaccctaccaataaatttttaaaaatatcctccttttccttttcctttgaaggacaagaagttttggcntctttgtcgcccccaggctgggattgcaatgggcacccatctcagccccactgcaacctctgcctccccagatcccaagtgattgtcctgcctcagcctccagagtagctgagacaggagaatctcttgaatccagaaggcagaatttacagtgagccgagataacgcctctgcactccagcctaggccatagagcgagactccatctga

SEQ ID NO: 10402 - DNA, 303 bp, Homo sapiens
gtcatatttccaacaagctgccttctttccttggggatttcttttgcattacaaagaacattatcccttcattgaacccagtttgaaagccacaagtagtttagcaaatattagaatacctgaagttactaagtgttggtgaagacgtggggagacaagcatgttatttatggaagtggacttgctatgttacccagagtactggagtgcagtggcatgatcctcaactccccaggccaagtgattctactacttcagccttgggagtggctggaaccacaggcgtgcaccaccatgcccagg

SEQ ID NO: 10403 - DNA, 349 bp, Homo sapiens
ccacatttacaaaacatttctatgaggaaataatgcccaaaaagtgtagaaaaggaatccaactaaggaaaatagattcctacattacagtctgaccagtgtctctgatgccttcctcatcaaagaaacagaagaatgactaatccaaaataatgaataatccaaaactctgtataatgaataatattaattcctcacagatacctatttgagttcctactgtgtgaattattttgccaatctctaggttcaattatgagtaattcataattcttgccctcagggagcttccattctagtaaggagatatttacagtctttctttgctgatgttgtgctaggagaaggc

SEQ ID NO: 10404 - DNA, 2565 bp, Homo sapiens
ccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatgaactctagtattaatgccctatatttgatggcactttatagttcataaaattaatttcaccccattctcattggacccatttcccaagtatttattgaggccctgtaacaaacatgtcaggaactcttctgggtgcttgagacacatccatgaataaaatagggggagaagctgttgacctcgtagagcttatgtctcgtggatgtacctgatcttcagaacccgtggatattcctgcaaatcctctgggcctgtattcattgctttgtcagcatcttgccctgaaatgcatttgtcacctacctcttgttactaaatggtctctgccctccagacccttgtcatccaaggcactaggggtcctggacacccactggggatgatgagctggtagcgacctgttttgcatgagtgccaagtcaggaaaaataaagatatttgtaggcattaaaaaaaaatacatttctttaaaaatgagaagatgcaatatttgtaaactgttgaagcttccttattgtgccatcacttaagggtttcatttctgtttaaagttctggaagctgcataactagcgtggactgactgctgtgtcattgtgctgtgcctttgaaccctggctgagtgagtgagtttgtcctttgttgatagtgtcctataattgcaaaatgtggtttgtcttctgatgcctcttaataccagattcttttactgagatttttttttttcattttccattgtaaataaggtaaatggtaatgactaacacaaagctgtattactcagcccactttgaaacgtggttttatcacctgttcttgttaggcagcatggtgtctaattttggcttagcaaatgacgctccttggtcttcctggctcattagctgtgcccacgaggctgcactgactgggtcgtaaatgtatctgagatgtccacacggggctgctgctgctcctctgtaatactgaggtccacatgcaaaatcagctttttttcccccgtaattatcagagcagctaggcagggctgacagccaggcagactcagtgggaggcttctggcctgagtgtggccttccccagagggtggttttccaaaggcaggtggggactggggaggcctcggggggctgcttgtcattacctgaatcacagatgctcttttgtcatacacagccagcattcctctgggtttcagcaagttggcatatcttaagcttcagaaggagctgggccttgctgactttcctatctggcctcttccctatctcctgtggggccaagagcttaggacagtgtctcagatctattcaaatgttaagaaatattttgttttctgtatttttctattctttagaaatttttttataatagataatttcaaacctatataaataaatccttatgtatttatcatttgactttattataaactcataatcaatcttgaaaaatctc

SEQ ID NO: 10405 - DNA, 667 bp, Homo sapiens
cccccccccctctttggggggaaaaatttttttgggggggggggttttttcccgggggtgttaaaaaaatgttattctgaagatgtccacacggggctgctgctgctcctctgtaatactgaggtccacatgcaaaatcagctttttttcccccgtaattatcagagcagctaggcagggctgacagccaggcagactcagtgggaggcttctggcctgagtgtggccttccccagagggtggttttccaaaggcaggtggggactggggaggcctcggggggctgcttgtcattacctgaatcacagatgctcttttgtcatacacagccagcattcctctgggtttcagcaagttggcatatcttaagcttcagaaggagctgggccttgctgactttcctatctggcctcttccctatctcctgtggggccaagagcttaggacagtgtctcagaaaagcctctaagtagggggtttttcccatgggattgtggtagtctgatttttcatatctattcaaatgttaagaaatattttgttttctgtatttttctattctttagaaatttttttataatagataatttcaaacctatataaataaatccttatgtatttatcatttgactttattataaactcataatcaatcttgaaaaatctc

SEQ ID NO: 10406 - DNA, 2621 bp, Homo sapiens
ccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatgaactctagtattaatgccctatatttgatggcactttatagttcataaaattaatttcaccccattctcattggacccatttcccaagtatttattgaggccctgtaacaaacatgtcaggaactcttctgggtgcttgagacacatccatgaataaaatagggggagaagctgttgacctcgtagagcttatgtctcgtggatgtacctgatcttcagaacccgtggatattcctgcaaatcctctgggcctgtattcattgctttgtcagcatcttgccctgaaatgcatttgtcacctacctcttgttactaaatggtctctgccctccagacccttgtcatccaaggcactaggggtcctggacacccactggggatgatgagctggtagcgacctgttttgcatgagtgccaagtcaggaaaaataaagatatttgtaggcattaaaaaaaaatacatttctttaaaaatgagaagatgcaatatttgtaaactgttgaagcttccttattgtgccatcacttaagggtttcatttctgtttaaagttctggaagctgcataactagcgtggactgactgctgtgtcattgtgctgtgcctttgaaccctggctgagtgagtgagtttgtcctttgttgatagtgtcctataattgcaaaatgtggtttgtcttctgatgcctcttaataccagattcttttactgagatttttttttttcattttccattgtaaataaggtaaatggtaatgactaacacaaagctgtattactcagcccactttgaaacgtggttttatcacctgttcttgttaggcagcatggtgtctaattttggcttagcaaatgacgctccttggtcttcctggctcattagctgtgcccacgaggctgcactgactgggtcgtaaatgtatctgagatgtccacacggggctgctgctgctcctctgtaatactgaggtccacatgcaaaatcagctttttttcccccgtaattatcagagcagctaggcagggctgacagccaggcagactcagtgggaggcttctggcctgagtgtggccttccccagagggtggttttccaaaggcaggtggggactggggaggcctcggggggctgcttgtcattacctgaatcacagatgctcttttgtcatacacagccagcattcctctgggtttcagcaagttggcatatcttaagcttcagaaggagctgggccttgctgactttcctatctggcctcttccctatctcctgtggggccaagagcttaggacagtgtctcagaaaagcctctaagtagggggtttttcccatgggattgtggtagtctgatttttcatatctattcaaatgttaagaaatattttgttttctgtatttttctattctttagaaatttttttataatagataatttcaaacctatataaataaatccttatgtatttatcatttgactttattataaactcataatcaatcttgaaaaatctc

SEQ ID NO: 10407 - DNA, 486 bp, Homo sapiens
taagacatgatcactaccctcaaggaacaaataagttaactgaggatgtgagagataaatcacataaagctaactaataatcctataattataataataaaagactatgcaataaagatcagaaggtagtgtattattaattgccaactaagttaggtagttcataaggaatacaaaaattagctgggcatggtggtgggcacctgtagtcccagctactccggaggctgaggcaggagaattgcttgaacctgggaggcagaggttgcagtgagtcgagttcgagccactgcactccagcccaacgacagagcgagactctgtctcaaaaaaaaaaagaaaaaagaaaaagaaaaagaaaaaagaaaagctccagagataatatgaatcctagggtaatgttatgttcctcaagatctgatttctatttacttttggtagttccaggtcattttcattagatcagggattgagatgattcaaagc

SEQ ID NO: 10408 - DNA, 420 bp, Homo sapiens
tctttgactcaattttctcacttataaaatggggataatacacttgagcatgggaggtagaggctgtagtgagctatgatcacaccactgcactctagcctggacaacatctcacccaggctagaaatctcacctttgaaatctcttaaatgataagagtggcttttgaatgctagtgagatgactggttgcaggatgggggctggtcaccagaaagaccgaggcatgatgagtgttgggactttcagccccatctcccagccaccagggaggggagagaggctgcagactgagttgatcaccaatgaccagtgtaatcaatcatgcctatgtaataaagtttccataaaaagttaaaaggataggctttattctgcaagcaatcaaataataaatctattctgctaagagaaaaacaaa

SEQ ID NO: 10409 - DNA, 266 bp, Homo sapiens
acattctctggtggcaactatagcagtaagagtcacaggatgaacagtcaggtggaggatgaccacattgagttgcctagctgaaacatgtgctctgtctatgtctgcaaagtgaaagaaagctacactatctcttcaacatagatcagtgggggaaattttatacttgggatgatttatatgaatgcatctcatcaaagttcacaacacattttttttttcagttttttattttcagtttttagagtcagggccttgctctgtcg

SEQ ID NO: 10410 - DNA, 462 bp, Homo sapiens
aaaaaatgaataaaattgataaaaccttgcaagggaaaataagaaggcaagtcatcaatatcagaaatgaagaaggaagcattgctacaacttctatagagattcaaaaagataatggaaggatatgagggcgatcaggctgtgacgcctgtcaccccactgattgccagggttgatttggctgatctggctggctaagcgggtgtccccttcctccctcaccactccacgggcatccctcccgaagctgcacgcctcgtggaagaaaatgaccatccccgaggaggaccggtctttggtcaaggatataggagtagctgtgctcccgtgatagattcttcagacacggtctcaagcttcatttgtaggagaacgtagggtagtcgagcttccaagacctcagacacatccaaatgaggtgtgacgtgtggcagtctgcttttaaaaaggaaaaaaagaaaa

SEQ ID NO: 10411 - DNA, 267 bp, Homo sapiens
tatgtattctctgaccgttttcaactattggccatgactatcattttctcccaggaatattaaattcatttaaagcccagagaacagtgttgcataaaatttgcttttaaatgatgtccttcagtgatatttattgaaggcattatcatatattctaagaatattttgattctctaacttatagaaggcaacctagctcttaatgtaatgtgattttaactttccttgtcttgtttattttcagtttggtgacttactctctccttt

SEQ ID NO: 10412 - DNA, 421 bp, Homo sapiens
agcccccgaaaacatggccagactgcttttttaagtgagtccccaaacttgttctatatcaccaggtagagccacccaaccagggtcttcggctacgcccaccagtgttctctgtctgacagaggtttcaggtctccctggaacagagctcccaagacgaaaggaaggccaccatctttgctgttcaggtgactcagccattccagccttcagccttaagaggtgaccaggggctgaagtgtgcccccagcccagcacagctgctcaacaaaaacatggccggactatatttttaagcaggtccccaattccattcctcctgaatggaagagaccgcccatccggggtcaccagccacctcctacaggtgcatttgggccagcaacaggtctgtacctccctgggatggagctctctgata

SEQ ID NO: 10413 - DNA, 5767 bp, Homo sapiens
  misc_feature (32)..(32): n is a, c, g, or t
  misc_feature (34)..(34): n is a, c, g, or t
tggtcgatctagaggtccctgttagtcaggcngnctcaaactcctgacctctggtgatcccccacttgggctcccaaagtgctgggattacaggcgtgagcaccacgcccagccacttgaagatttttcttgtttgtgatcaccttctcatactggccttactcagcttagtagagtaagcactgaattgggtaaggtaacctcacttcctaacatgtcagcttcttatcttttcttcctttacctaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggactttttttttttttttttggccttttgtacaaagattagtttcaatgtagtctgtagcctcctttgtaaaccaattaaaaagttttttaataaaaaaaaatgt

SEQ ID NO: 10414 - DNA, 4766 bp, Homo sapiens
  misc_feature (11)..(11): n is a, c, g, or t
  misc_feature (22)..(22): n is a, c, g, or t
  misc_feature (24)..(24): n is a, c, g, or t
ctcgtgcgatntcggcagcgangngggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggactttttttttttttttttggccttttgtacaaagattagtttcaatgtagtctgtagcctcctttgtaaaccaattaaaaagttttttaataaaaaaaaatgt

SEQ ID NO: 10415 - DNA, 3789 bp, Homo sapiens
  misc_feature (210)..(210): n is a, c, g, or t
  misc_feature (282)..(282): n is a, c, g, or t
caaatttgtagccagttccaaacaaatttaaatattgagttgagacctgtatggaattgtgttcgcaggagataaggcttgcctttgagcctactcttgattcatgcagagtgccaataagataaatcaaccaagttttggggcctcaaaagagacaccagcaactgggccttgagaacttccatttttttgcagattgtctgcagaaantcagacagctcatcagcagcagcagctgtattgtattttacctcatcttcagagtttatgttctactgaaanaggacgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggactttttttttttttttttggccttttgtacaaagattagtttcaatgtagtctgtagcctcctttgtaaaccaattaaaaagttttttaataaaaaaaaatgt

SEQ ID NO: 10416 - DNA, 5680 bp, Homo sapiens
  misc_feature (32)..(32): n is a, c, g, or t
  misc_feature (34)..(34): n is a, c, g, or t
tggtcgatctagaggtccctgttagtcaggcngnctcaaactcctgacctctggtgatcccccacttgggctcccaaagtgctgggattacaggcgtgagcaccacgcccagccacttgaagatttttcttgtttgtgatcaccttctcatactggccttactcagcttagtagagtaagcactgaattgggtaaggtaacctcacttcctaacatgtcagcttcttatcttttcttcctttacctaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttgttggagcttgggtcctctatgagtcag

SEQ ID NO: 10417 - DNA, 5714 bp, Homo sapiens
  misc_feature (32)..(32): n is a, c, g, or t
  misc_feature (34)..(34): n is a, c, g, or t
tggtcgatctagaggtccctgttagtcaggcngnctcaaactcctgacctctggtgatcccccacttgggctcccaaagtgctgggattacaggcgtgagcaccacgcccagccacttgaagatttttcttgtttgtgatcaccttctcatactggccttactcagcttagtagagtaagcactgaattgggtaaggtaacctcacttcctaacatgtcagcttcttatcttttcttcctttacctaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcctccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggactttttttttttttttttggccttttgtacaaagattagtttcaatgtagtctgtagcctcctttgtaaaccaattaaaaagttttttaataaaaaaaaatgt

SEQ ID NO: 10418 - DNA, 2744 bp, Homo sapiens
  misc_feature (32)..(32): n is a, c, g, or t
  misc_feature (34)..(34): n is a, c, g, or t
tggtcgatctagaggtccctgttagtcaggcngnctcaaactcctgacctctggtgatcccccacttgggctcccaaagtgctgggattacaggcgtgagcaccacgcccagccacttgaagatttttcttgtttgtgatcaccttctcatactggccttactcagcttagtagagtaagcactgaattgggtaaggtaacctcacttcctaacatgtcagcttcttatcttttcttcctttacctaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaatt

SEQ ID NO: 10419 - DNA, 849 bp, Homo sapiens
aacaagatgagagagcatttaaaagcatttacccacacagccctggtgataattggattggaatcaaaacaaacacagcatgagattattaagaggttttaaaaggcaacagtggtgtggactggttattgccagtgttaagagagaaataaacttgggtttttaggcaccaggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggactttttttttttttttttggccttttgtacaaagattagtttcaatgtagtctgtagcctcctttgtaaaccaattaaaaagttttttaataaaaaaaaatgt

SEQ ID NO: 10420 - DNA, 5736 bp, Homo sapiens
  misc_feature (32)..(32): n is a, c, g, or t
  misc_feature (34)..(34): n is a, c, g, or t
tggtcgatctagaggtccctgttagtcaggcngnctcaaactcctgacctctggtgatcccccacttgggctcccaaagtgctgggattacaggcgtgagcaccacgcccagccacttgaagatttttcttgtttgtgatcaccttctcatactggccttactcagcttagtagagtaagcactgaattgggtaaggtaacctcacttcctaacatgtcagcttcttatcttttcttcctttacctaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggactttttttttttttttttggccttttgtacaaagattagtttcaatgtagtctgtagcctcctttgtaaaccaattaaaaagttttttaataaaaaaaaatgt

SEQ ID NO: 10421 - DNA, 1413 bp, Homo sapiens
agcggacgggctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccagtgttatttgtacctgttctacagtccagccaggactatgaaggtggtgcttatgctgctctttatttgcctgggcaacatgtacctgcacgggctgaggaacctctggcaaatccttttccacataggagtggcttttctgtcttcatatcagatactaacaaggcagcttcaggagaagcagtctgactgtggagtatgaggatgacactgtgatgaatggattctttgattttcttttgaggatcaatctatgtttctctttctgcttctctactttacactccagtttccatccttttcagccaactggactgaaaaaccaggaattggggatgttaaacagttgcagtggaagtcatgaggttgcttgatacccagccttggttctgtgccaagcattactgcaggatctccagccagttcagcacgtttacctaggacagctggatctgggggctcatccagaaagagctttattggaagagagaaaggaaatattttggtcttttaagttgaatgatacagtaaaccacttgattcaataac

SEQ ID NO: 10422 - DNA, 1158 bp, Homo sapiens
agaggagttgtctggagctaagggacatcactttgatggttgctctttcttcagtaacggaggttcctgggagagcaagcgggggagggggggttgaagagtgggagatctggggagcatgcaggatatttggaagttgattttgggggagagctggagagagagctgccttggcaaataggagcgctgaaaggtgttgaggacctagttgaagttgacaatgtatgtagcactgatctgtgtggttgtgagattttgtccagcagcacttagagccaagaagcagattcagagaagacagaaggttggattcttccaggattgtagtgctgccagatgggtgttactatccttctagttatgccagaaagataactgtgcaaggaatataagtatattgggaagaatgtgatggaggtgataaaccctgaactctcagctgatggggaaggaaatgaagactcgatggagcttataaataaaacaaagtagagggacaaatgaactggaagtttctgcaggctagagaaaccatgaaaggaattcagagaatagcagaaggacagatgaaagatcaggtgtctgcatttataacttcagaggtggagctcttctgtggtccagggtgttaccctaggagtggaggactgaagaggactggaagagaaagactctggagttgactgtgaacctggagccaaagtgaacaatgattggagatgagagctaggactttaggtactacatctcacccctgttgtccaatctaccatggtgcctgaaccacaccagttgcaccagtcagagagtgtaaggtcctgttctaaagcactcgcaccacaagttttgagagcccaattccccatatttgtttgtttgttttgttttgttttgtttgttttttgagatggagtttcgctcttgtaggtcaggctggagtgcaatggtgcgatctcggcccactgcagcctcctcctcccaggttcaagtgattctcctgcctcagcctcccaagtagctgggatcacagatgtccaccatcacgcccggctaatttctccggacgtgagaattacaggcttggatctcaaaccgccgcggtgagagccgggaggtgggaagaaagttgggaggcgcgcgcccccgtcacactccctc

SEQ ID NO: 10423 - DNA, 889 bp, Homo sapiens
agaggagttgtctggagctaagggacatcactttgatggttgctctttcttcagtaacggaggttcctgggagagcaagcgggggagggggggttgaagagtgggagatctggggagcatgcaggatatttggaagttgattttgggggagagctggagagagagctgccttggcaaataggagcgctgaaaggtgttgaggacctagttgaagttgacaatgtatgtagcactgatctgtgtggttgtgagattttgtccagcagcacttagagccaagaagcagattcagagaagacagaaggttggattcttccaggattgtagtgctgccagatgggtgttactatccttctagttatgccagaaagataactgtgcaaggaatataagtatattgggaagaatgtgatggaggtgataaaccctgaactctcagctgatggggaaggaaatgaagactcgatggagcttataaataaaacaaagtagagggacaaatgaactggaagtttctgcaggctagagaaaccatgaaaggaattcagagaatagcagaaggacagatgaaagatcaggtgtctgcatttataacttcagaggtggagctcttctgtggtccagggtgttaccctaggagtggaggactgaagaggactggaagagaaagactctggagttgactgtgaacctggagccaaagtgaacaatgattggagatgagagctaggactttaggtactacatctcacccctgttgtccaatctaccatggtgcctgaaccacaccagttgcaccagtcagagagtgtaaggtcctgttctaaagcactccagcctgacctacaagagcgaaactccatctcaaaaaacaaacaaaacaaaacaa

SEQ ID NO: 10424 - DNA, 423 bp, Homo sapiens
taatggaatggtgataggtgagggaaataattttcccattgatacagggtaactcacctctacttggctttgtgtgggaaggaaaaataaatttcacctaagaaattgaaatgttgttcttgcgcctcgtaaaaggttgaagttggagtgtatactccccaaagtctaggaattcctaagccaaggttgaaacatcagtattggtcccagagtgatgacactgctatggtagccagccagagcaaatgcagaaccacactggaagaagtgtgccacaacttgggcttcaggggattcttacaaaaaaaagtcccatagggatgagttctcagcaaaaaggacaaaacacaagaggagacattccacttcttctttgccaaactgaactgccgactctatcgatcccttaccttcaatgagacc

SEQ ID NO: 10425 - DNA, 1554 bp, Homo sapiens
agcggacgggctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10426 - DNA, 1565 bp, Homo sapiens
atcactctgtcacgcggagcctccccgcctccagacgtcagtccggttgctaccccggcaggaatcgagcttagatcacgaaggctccttctcacctccggacgtgagaattacaggcttggatctcaaaccgccgcggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10427 - DNA, 1857 bp, Homo sapiens
agcggacgggctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaaaaaaaaaaaacaacccacccaacaaaactttttgggccggccacgggcccctagaaaaaaggttttccaacaacccactccgtcgtggcgcggcggggccccaattagggtcctcggtgacccgtgggtccaacagtggtgtcccaaagagaaacccgtgggcacaggacaacgcggcgctgggtctccccaccccaataaaaaaacgccgccgcgggaacaccggcgtcgtctggaacaactcccaaagggaggtgccagaaggccaacaggggaccctacacgggggccccgggaggccgg

SEQ ID NO: 10428 - DNA, 1678 bp, Homo sapiens
agcggacgggctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacaactactagacattttaaaggaagcggaagaaagacagtctcaggaataggtcgaactgaagagacaatatacctgcagcaaacagctacaggactgtttaaagccaagcaagtgcagaattcagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10429 - DNA, 1878 bp, Homo sapiens
agcggacgggctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacagtgagcagtaccatagcttttaatagtaaggagtgtgttagttccctaaggctgccataacaaatgaccacaaactggcttcaaacaacagaattcgttctctcacagatgtggagaagtctgaggctaattcccccaatagaatatgcatccctcatgcatgaataaataagagtgatcacaggctgtcattgattaagactactagacattttaaaggaagcggaagaaagacagtctcaggaataggtcgaactgaagagacaatatacctgcagcaaacagctacaggactgtttaaagccaagcaagtgcagaattcagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10430 - DNA, 3892 bp, Homo sapiens
agcggacgggctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccagtgttatttgtacctgttctacagtccagccaggactatgaaggtggtgcttatgctgctctttatttgcctgggcaacatgtacctgcacgggctgaggaacctctggcaaatccttttccacataggagtggcttttctgtcttcatatcagatactaacaaggcagcttcaggagaagcagtctgactgtggagtatgaggatgacactgtgatgaatggattctttgattttcttttgaggatcaatctatgtttctctttctgcttctctactttacactccagtttccatccttttcagccaactggactgaaaaaccaggaattggggatgttaaacagttgcagtggaagtcatgaggttgcttgatacccagccttggttctgtgccaagcattactgcaggatctccagccagttcagcacgtttacctaggacagctggatctgggggctcatccagaaagagctttattggaagagagaaaggaaatattttggtcttttaagttgaatgatacagtaaaccacttgattcaataacactggttttagtcattgagagttgtctccaaggaaccactttaaaatccaaatcagctttcagtctaaacataacttgattagttttttttttcagagggtcagtacaggatgaattaaaaacctaaaaatatggttcataaatgtaagctagataaattttgtttacattttttcaatatcttaggttcgatatacctttggaatatttaattatattttggatataaattggacttcatttagggtgagggcaaacttaagctgagaaaatggttaagaaatctgagtttatttaatttatatgtaaccttttatagtggtgggactgtttgggtacagagatgttttatatttatttgcagggtatatccgaatattttaaaaattaattgaataaccagtacttctagatgataagtttgtcagcatgagcagaaatgagaatttcaggattacttacaattgaccacaacctggagtaggtgaatgaacatggattcagtggcactttacagatccgcttgggaggggctgctgtcatcagccttttcagtagagctgagtgcctgttgttttaatgatgatgactactgtaccctgtgtacctgttcccagagcgcctccaaaattaattactcctctgcacctttcccagtcatcttaattagcttgagggcctcattttttatgaacaagagttaagtatctgttaactttttaaagcttgatagagatataattaacacatactctggaaagttactctctttcactgtcaaaaaattgattgatcacagttttccaaaatatggttctggataagatcccttaggtttcccgaaatttcagcctggcttgttttgtaccacgcaggaggtcattttgggagtttgctctttggattgttcttggtagaagtctggaatctgaatagttcaaccacagttgcatggaacactttgagtgttcaactgcattatgtggtcttgataaatttttaaaaatcctattttgatagtttttaaaagtggaaaaccattacaagagttgagtggatagggaatgtaagaatgtagttttagaaaaattcaattatatttggttatcactggtattgtattgttattgagctaccttgttatcattttaagaaaaataagtttatatactgggaactatgttgggaaaatgttgccatagtaactttattttttataatagaattttctatttttgaccaaacataaaatatttggatatgggccaggcatgatggctcatgcctgtattcccagcactttggaaggccaaagcaggagactcggttgaggccagtagtttgagaccagcctggacaacatagtaagattcatctctacaaaaaaaaaaattagccggatgtgatggcacatgcctgtaatcccagcactttgggagtctgaggcaggaggatcccttgagtccaggagtttgaggcttccatgagctataatcacaccactgcaccccagcctgcatgacagagtgaaaccctgtctctaaaaagtctgaatatgaaaattatattggcagcatactcagacataaactccaaagttgtctctacactgatttcacatctgcataattttctgcatacccagcaggtgaattttcagtttttctgggagacaattttgaagagatggtgaaatagaatgggaagttaaggaggggaggtaaaatgttttaaatgagaagaacaaaaaagctttaaaagtcaataacactttgggaagctgaggtgggcagatcacgaggtcaagagatcgagaccatcctggctaacatggtgaaaccccatctctactaaaaatacaaaaattagctgggcacggtggcttgtgcctgtagccccagctactcaggaggctgaggcaggagaatctcttgaacccgggaggtggaggttgcagtgagccgagatcgagccactgcactccagcctggtgacaaagcaagactccgtctcaaaaaaaaaaaaaaaaaaagtcggtaagaacggcttaaaaatggactgttttcttttcctatgtggcattgggttgccatgtagacctgtaccccaggtgctttgggcatctgagcctatgatccatattcagcaggcagtaaagaaacggtccttgaagatgagtccttcctggtaatgcttcctgaccaccgaggcactaccagagatgttatccacaccaggtcgaatgtgtggatattagttaacatctacatggggtgagattgacttttgcaaacaaaagggaaaagatgcactagaaaaacagtacaagtaatgaccacaaaaacattgtttgactgaaatccagctagctaaaagaatcctcagctcactgaaggaagagactgaaaataggaaagaagttctggtgatttcatctgagggaaatccccaggcttaggtttgacttggttcagggttg

SEQ ID NO: 10431 - DNA, 1254 bp, Homo sapiens
cagacattgctcacattccaaatgttttcgtgtagaatattgcacaggtctggggacgctctacctgtgccctgtgagtgttaataatggtggagaaagagtgtagctgtgcccttgagagagaaggtgagggaaagagtgcaccagtcagctgaccgtcagctggctaggctcttcactgagtcctatgtcgcagtgcacaaatcactgcccatcaggcctcagtttcctcatctggtaaatggtgataacatcaatctgcccccccgccaggtgcctgttatgagggtcaaaagtggtagtggagggtaatactgggtgagtccattgtgtgtgggaggagaaaggctttacattcacctggtacatgaaggtttttctgcttcaggcagcacagcacagccatttcttctggcctttacaaaaaggcattttgttatactacagtgtaaacctcatttttttcactccaaaaggtagcagcccctcttcttcccaccctggacctgcctttcactccctgggcacagagcgcatggtaccattgatgtttggtttattccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10432 - DNA, 693 bp, Homo sapiens
tctcccacccatgcctgggagtcaagtgttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10433 - DNA, 654 bp, Homo sapiens
gcgagcttcgaccccacgatattcgggcagcataggaccctttccctttcattaagaaatttgtaactgatttggggagtttagacaaaccgacatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10434 - DNA, 896 bp, Homo sapiens
agcggacgggctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctccagccagttcagcacgtttacctaggacagctggatctgggggctcatccagaaagagctttattggaagagagaaaggaaatattttggtcttttaagttgaatgatacagtaaaccacttgattcaataac

SEQ ID NO: 10435 - DNA, 1557 bp, Homo sapiens
cagacattgctcacattccaaatgttttcgtgtagaatattgcacaggtctggggacgctctacctgtgccctgtgagtgttaataatggtggagaaagagtgtagctgtgcccttgagagagaaggtgagggaaagagtgcaccagtcagctgaccgtcagctggctaggctcttcactgagtcctatgtcgcagtgcacaaatcactgcccatcaggcctcagtttcctcatctggtaaatggtgataacatcaatctgcccccccgccaggtgcctgttatgagggtcaaaagtggtagtggagggtaatactgggtgagtccattgtgtgtgggaggagaaaggctttacattcacctggtacatgaaggtttttctgcttcaggcagcacagcacagccatttcttctggcctttacaaaaaggcattttgttatactacagtgtaaacctcatttttttcactccaaaaggtagcagcccctcttcttcccaccctggacctgcctttcactccctgggcacagagcgcatggtaccattgatgtttggtttattccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaaaaaaaaaaaacaacccacccaacaaaactttttgggccggccacgggcccctagaaaaaaggttttccaacaacccactccgtcgtggcgcggcggggccccaattagggtcctcggtgacccgtgggtccaacagtggtgtcccaaagagaaacccgtgggcacaggacaacgcggcgctgggtctccccaccccaataaaaaaacgccgccgcgggaacaccggcgtcgtctggaacaactcccaaagggaggtgccagaaggccaacaggggaccctacacgggggccccgggaggccgg

SEQ ID NO: 10436 - DNA, 2527 bp, Homo sapiens
agaggagttgtctggagctaagggacatcactttgatggttgctctttcttcagtaacggaggttcctgggagagcaagcgggggagggggggttgaagagtgggagatctggggagcatgcaggatatttggaagttgattttgggggagagctggagagagagctgccttggcaaataggagcgctgaaaggtgttgaggacctagttgaagttgacaatgtatgtagcactgatctgtgtggttgtgagattttgtccagcagcacttagagccaagaagcagattcagagaagacagaaggttggattcttccaggattgtagtgctgccagatgggtgttactatccttctagttatgccagaaagataactgtgcaaggaatataagtatattgggaagaatgtgatggaggtgataaaccctgaactctcagctgatggggaaggaaatgaagactcgatggagcttataaataaaacaaagtagagggacaaatgaactggaagtttctgcaggctagagaaaccatgaaaggaattcagagaatagcagaaggacagatgaaagatcaggtgtctgcatttataacttcagaggtggagctcttctgtggtccagggtgttaccctaggagtggaggactgaagaggactggaagagaaagactctggagttgactgtgaacctggagccaaagtgaacaatgattggagatgagagctaggactttaggtactacatctcacccctgttgtccaatctaccatggtgcctgaaccacaccagttgcaccagtcagagagtgtaaggtcctgttctaaagcactcgcaccacaagttttgagagcccaattccccatatttgtttgtttgttttgttttgttttgtttgttttttgagatggagtttcgctcttgtaggtcaggctggagtgcaatggtgcgatctcggcccactgcagcctcctcctcccaggttcaagtgattctcctgcctcagcctcccaagtagctgggatcacagatgtccaccatcacgcccggctaatttctccggacgtgagaattacaggcttggatctcaaaccgccgcggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10437 - DNA, 1505 bp, Homo sapiens
acttactaaattttccagtacttcttcctatggttcatgatagtaaacacagaaacatataaggaacattattagagttaccagatgttagcccacagggggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10438 - DNA, 1576 bp, Homo sapiens
agcggacgggctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaaaatgtgtctttgcacttatgtg

SEQ ID NO: 10439 - DNA, 1572 bp, Homo sapiens
agcggacgggctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacatttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgagttctcgcaatgccgattaatctaagcgttttcacacacaaacaacaacaacaaaaaaaac

SEQ ID NO: 10440 - DNA, 1647 bp, Homo sapiens
agcggacgggctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacaagacaaggtcttgccatgttgcccaggctggtcttaaactcctaggctcaagtgatcctcccgccttggccttccaaagccctgggattatagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10441 - DNA, 1770 bp, Homo sapiens
agcggacgggctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacaatgtggagaagtctgaggctaattcccccaatagaatatgcatccctcatgcatgaataaataagagtgatcacaggctgtcattgattaagactactagacattttaaaggaagcggaagaaagacagtctcaggaataggtcgaactgaagagacaatatacctgcagcaaacagctacaggactgtttaaagccaagcaagtgcagaattcagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10442 - DNA, 2171 bp, Homo sapiens
taatggaatggtgataggtgagggaaataattttcccattgatacagggtaactcacctctacttggctttgtgtgggaaggaaaaataaatttcacctaagaaattgaaatgttgttcttgcgcctcgtaaaaggttgaagttggagtgtatactccccaaagtctaggaattcctaagccaaggttgaaacatcagtattggtcccagagtgatgacactgctatggtagccagccagagcaaatgcagaaccacactggaagaagtgtgccacaacttgggcttcaggggattcttacaaaaaaaagtcccatagggatgagttctcagcaaaaaggacaaaacacaagaggagacattccacagtgagtgggagtcagtagacacacagataggtgacctagaacccctgtaccctgaacttgaaatgattgcatgacagcccaaaagggagtagaaaaagaagaaaagccctgtatttattttatgagaccaaaataacctaaataccacaatcagatgaagacagtataagaaaggaaaattataggccagtcttatttgcatagacacaaaagtcccaattaaaatgttagcaaactaaatccagcagttgtatgtttatgaatatgtaggaacttagatccaacaagggcttattttaggatgccaggatcatttaacattaggaaatctgttgatgtagattaaagaagaaaaacgttttctcaatagatgtggagaagtctgaggctaattcccccaatagaatatgcatccctcatgcatgaataaataagagtgatcacaggctgtcattgattaagactactagacattttaaaggaagcggaagaaagacagtctcaggaataggtcgaactgaagagacaatatacctgcagcaaacagctacaggactgtttaaagccaagcaagtgcagaattcagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10443 - DNA, 1460 bp, Homo sapiens
  misc_feature (383)..(383): n is a, c, g, or t
gctgactgcgtgcggagcgatgcgcacagaatttgacgaaactgtactgaaacggcttgcacgagttgtaccattgaagtatagggccagatatcgcaacggctagggtactactaaaggttgtgacctatagatttactgtgtatgcttcctttctgggaacgttggacctcgacactagctcattctgcctcagtgccctaagcagtcaaacccgagagcaatagtggccctccttgcttgtcctggaaaaccgcgtgcttcgatgtggcaagtccagagggtacctgtatgatcatctcagctgacatctgagcacctaagtcgcctcgcaaggacacatgtaacaaccttagtgttcgtctggaaggtgtgtcgatcangctaatcagttcagtagatagattagccatagagcatattataactaatagataaagttaccatcatcaagatggaagatgcaagcacttggaaaaaattcaggaggagctcaagttgcagcctccagcggttctcactctggaggacacagatgtggcaaatggggtgatgaatggtcacacaccgatgcacttggagcctgctcctaatttccgaatggaaccagtgacagccctgggtatcctctccctcattctcaacatcatgtgtgctgccctgaatctcattcgaggagttcaccttgcagaacattctttacaggttgcccatgaggaaattggaaacattctggcttttcttgttcctttcgtagcctgcattttccaggatccaaggagctggttctgctggttggaccaaacctcgtgagccagccacccctgacccaaatgaggagagctctgattctcccatccgggagcagtgatgtcaaacttctgctgctggggaaatctcatcagcagggagcctgtggaaaagggcatgtcagtgaaatctgggaatggctggattcggaaacatctgcccatgtgtattgatggcagagctgttgcccacaagcgccttttatttagggtaaaattaacaaatccattctattcctctgacccatgcttagtacatatgacctttaacccttacatttatatgattctggggttgcttcagaagtgttatttcatgaatcattcatatgatttgatcccccaggattctattttgtttaatgggcttttctactaaaagcataaaatactgaggctgatttagtcagggcaaaaccatttactttacatattcgttttcaatacttgctgttcatgttacacaagcttcttacggttttcttgtaacaataaatattttgagtaaataatgggtacattttaacaaactcagtagtacaacctaaacttgtataaaagtgtgtaaaaatgtatagccatttatatcctatgtataaattaaatgaggtggcttcagaaatggcagaataaatctaaagtgtttattaa

SEQ ID NO: 10444 - DNA, 2265 bp, Homo sapiens
agaggagttgtctggagctaagggacatcactttgatggttgctctttcttcagtaacggaggttcctgggagagcaagcgggggagggggggttgaagagtgggagatctggggagcatgcaggatatttggaagttgattttgggggagagctggagagagagctgccttggcaaataggagcgctgaaaggtgttgaggacctagttgaagttgacaatgtatgtagcactgatctgtgtggttgtgagattttgtccagcagcacttagagccaagaagcagattcagagaagacagaaggttggattcttccaggattgtagtgctgccagatgggtgttactatccttctagttatgccagaaagataactgtgcaaggaatataagtatattgggaagaatgtgatggaggtgataaaccctgaactctcagctgatggggaaggaaatgaagactcgatggagcttataaataaaacaaagtagagggacaaatgaactggaagtttctgcaggctagagaaaccatgaaaggaattcagagaatagcagaaggacagatgaaagatcaggtgtctgcatttataacttcagaggtggagctcttctgtggtccagggtgttaccctaggagtggaggactgaagaggactggaagagaaagactctggagttgactgtgaacctggagccaaagtgaacaatgattggagatgagagctaggactttaggtactacatctcacccctgttgtccaatctaccatggtgcctgaaccacaccagttgcaccagtcagagagtgtaaggtcctgttctaaagcactcgcaccacaagttttgagagcccaattccccatatttgtttgtttgttttgttttgttttgtttgttttttgagatggagtttcgctcttgtaggtcaggctggagtgcaatggtgcgatctcggcccactgcagcctcctcctcccaggttcaagtgattctcctgcctcagcctcccaagtagctgggatcacagatgtccaccatcacgcccggctaatttctccggacgtgagaattacaggcttggatctcaaaccgccgcggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactggcccagtatccaggtcgaggttctgcagaaggttgtgactttagtatacaatgtggagaagtctgaggctaattcccccaatagaatatgcatccctcatgcatgaataaataagagtgatcacaggctgtcattgattaagactactagacattttaaaggaagcggaagaaagacagtctcaggaataggtcgaactgaagagacaatatacctgcagcaaacagctacaggactgtttaaagccaagcaagtgcagaattcagtttttcttctttcggggacgtggcctgcatggctatctgctcctgccagtgtccagcagccatggccttctgcttcctggagaccctgtggtgggaattcacagcttcctatgacactacctgcattggcctagcctccaggccatacgcttttcttgagtttgacagcatcattcagaaagtgaagtggcattttaactatgtaagttcctctcagatggagtgcagcttggaaaaaattcaggaggagctcaagttgcagcctccagcggttctcactctggaggacacagatgtggcaaatggggtgatgaatggtcacacaccgatgcacttggagcctggtcctaatttccgaatggaaccagtgaaagggccgaggattccctgccccaatgtccaacctcaggtgtgcggcccgagattcaaacgagaggggccaccgggcacacacctcttaaggggtgccgcagagaaaggggaccaagcggggatcaagagccccggagaacgggaattccacataacagggaaggccgctcggtgtgcacacacggtggggaccccgggcagaagagaagagaactcaccacggcgggaaggaaaaacacgggggagaacacatcagcgggccgaggaggaacaaagatgagaagagaaccaactgctgaaagtaacagccgcagcataaatacagcacgacccaccacactcgcaagtgaactgactagcaagacaga

SEQ ID NO: 10445 - DNA, 3699 bp, Homo sapiens
  misc_feature (1299)..(1299): n is a, c, g, or t
ggtaattggcacggcgcgcgcgcaccccttccgcgcagccccctgacctgcagcctccggacctcgctgcagcgcggacccggcccgcccgcccggctgcgaggctcctggctgcacatgacgtcccggtgtttggctggcgcagcaggtcctccgggccaccggccaccttcccaagcagcaaaggtggaggcggctccagttacatggaggagatgtacttcgcctggttggaaaacccccagagtgtccacaagtcctgggacagcttcttcagggaagccagcgaggaagccttttctggctctgctcagccacggcccccttctgttgtccatgagagcaggtctgcagtctcaagtcggaccaagaccagcaaattggtggaggaccacctggctgtgcagtccctgatccgggcctaccagatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctttctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccagtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacntgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcagtcaccggcaccatgttctccatgaccaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccgggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaagagaggggctgtggggccccaggataaaacagacacagtgacagggccaagagccagcactgctggccttggtgtcatgccagaatctaccaggactgagggagccagaggagtcctgtaggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtatgaaatgcagccacagctcatgtgtaccaaagtagaaaaccaaatcacagagaaataaaaacatgcttcagagagaaaaaatgttttcatttcatgttgtaa

SEQ ID NO: 10446 - DNA, 545 bp, Homo sapiens
ccagcccatcgcgcgcgtaccacccggctagtccagggtcctgcgcagaggagcgggtgctcgcgaatgagtcagctgaggctgctgccgtcccgtcttggggtacaggctgcgaggctcctggctgcacatgacgtcccggtgtttggctggcgcagcaggtcctccgggccaccggccaccttcccaagcagcaaaggtggaggcggctccagttacatggaggagatgtacttcgcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtatgaaatgcagccacagctcatgtgtaccaaagtagaaaaccaaatcacagagaaataaaaacatgcttcagagagaaaaaatgttttcatttcatgttgtaa

SEQ ID NO: 10447 - DNA, 657 bp, Homo sapiens
ggtaattggcacggcgcgcgcgcaccccttccgcgcagccccctgacctgcagcctccggacctcgctgcagcgcggacccggcccgcccgcccgaatgagtcagctgaggctgctgccgtcccgtcttggggtacaggctgcgaggctcctggctgcacatgacgtcccggtgtttggctggcgcagcaggtcctccgggccaccggccaccttcccaagcagcaaaggtggaggcggctccagttacatggaggagatgtacttcgcctggttggaaaacccccagagtgtccacaagtcctgggacagcttcttcagggaagccagcgaggaagccttttctggctctgctcagccacggcccccttctgttgtccatgagagcaggtctgcagtctcaagtcggaccaagaccagcaaattggtggaggaccacctggctgtgcagtccctgatccgggcctaccaggtgaggggcagctgaggcacagcctgggaggctgcactggctcctggggtgtggccaggcactgaagggaaggggtctcagctccaacatcatctccccagagagcccttctccttgtcctctactgagcggcacctactcctctagccagtctttgccacatcaccattcagagcacttaccacc

SEQ ID NO: 10448 - DNA, 3395 bp, Homo sapiens
  misc_feature (1342)..(1342): n is a, c, g, or t
ggtaattggcacggcgcgcgcgcaccccttccgcgcagccccctgacctgcagcctccggacctcgctgcagcgcggacccggcccgcccgcccgaatgagtcagctgaggctgctgccgtcccgtcttggggtacaggctgcgaggctcctggctgcacatgacgtcccggtgtttggctggcgcagcaggtcctccgggccaccggccaccttcccaagcagcaaaggtggaggcggctccagttacatggaggagatgtacttcgcctggttggaaaacccccagagtgtccacaagtcctgggacagcttcttcagggaagccagcgaggaagccttttctggctctgctcagccacggcccccttctgttgtccatgagagcaggtctgcagtctcaagtcggaccaagaccagcaaattggtggaggaccacctggctgtgcagtccctgatccgggcctaccagatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctttctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccagtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacntgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaagagaggggctgtggggccccaggataaaacagacacagtgacagggccaagagccagcactgctggccttggtgtcatgccagaatctaccaggactgagggagccagaggagtcctgtaggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtatgaaatgcagccacagctcatgtgtaccaaagtagaaaaccaaatcacagagaaataaaaacatgcttcagagagaaaaaatgttttcatttcatgttgtaa

SEQ ID NO: 10449 - DNA, 1013 bp, Homo sapiens
ggtaattggcacggcgcgcgcgcaccccttccgcgcagccccctgacctgcagcctccggacctcgctgcagcgcggacccggcccgcccgcccgaatgagtcagctgaggctgctgccgtcccgtcttggggtacaggctgcgaggctcctggctgcacatgacgtcccggtgtttggctggcgcagcaggtcctccgggccaccggccaccttcccaagcagcaaaggtggaggcggctccagttacatggaggagatgtacttcgcctggttggaaaacccccagagtgtccacaagtcctgggacagcttcttcagggaagccagcgaggaagccttttctggctctgctcagccacggcccccttctgttgtccatgagagcaggtctgcagtctcaagtcggaccaagaccagcaaattggtggaggaccacctggctgtgcagtccctgatccgggcctaccagatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctttctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggtgggtccccctccctgctgt

SEQ ID NO: 10450 - DNA, 3742 bp, Homo sapiens
  misc_feature (1342)..(1342): n is a, c, g, or t
ggtaattggcacggcgcgcgcgcaccccttccgcgcagccccctgacctgcagcctccggacctcgctgcagcgcggacccggcccgcccgcccgaatgagtcagctgaggctgctgccgtcccgtcttggggtacaggctgcgaggctcctggctgcacatgacgtcccggtgtttggctggcgcagcaggtcctccgggccaccggccaccttcccaagcagcaaaggtggaggcggctccagttacatggaggagatgtacttcgcctggttggaaaacccccagagtgtccacaagtcctgggacagcttcttcagggaagccagcgaggaagccttttctggctctgctcagccacggcccccttctgttgtccatgagagcaggtctgcagtctcaagtcggaccaagaccagcaaattggtggaggaccacctggctgtgcagtccctgatccgggcctaccagatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctttctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccagtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacntgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcagtcaccggcaccatgttctccatgaccaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccgggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaagagaggggctgtggggccccaggataaaacagacacagtgacagggccaagagccagcactgctggccttggtgtcatgccagaatctaccaggactgagggagccagaggagtcctgtaggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtatgaaatgcagccacagctcatgtgtaccaaagtagaaaaccaaatcacagagaaataaaaacatgcttcagagagaaaaaatgttttcatttcatgttgtaa

SEQ ID NO: 10451 - DNA, 3714 bp, Homo sapiens
  misc_feature (1342)..(1342): n is a, c, g, or t
ggtaattggcacggcgcgcgcgcaccccttccgcgcagccccctgacctgcagcctccggacctcgctgcagcgcggacccggcccgcccgcccgaatgagtcagctgaggctgctgccgtcccgtcttggggtacaggctgcgaggctcctggctgcacatgacgtcccggtgtttggctggcgcagcaggtcctccgggccaccggccaccttcccaagcagcaaaggtggaggcggctccagttacatggaggagatgtacttcgcctggttggaaaacccccagagtgtccacaagtcctgggacagcttcttcagggaagccagcgaggaagccttttctggctctgctcagccacggcccccttctgttgtccatgagagcaggtctgcagtctcaagtcggaccaagaccagcaaattggtggaggaccacctggctgtgcagtccctgatccgggcctaccagatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctttctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccagtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacntgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccgggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaagagaggggctgtggggccccaggataaaacagacacagtgacagggccaagagccagcactgctggccttggtgtcatgccagaatctaccaggactgagggagccagaggagtcctgtaggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtatgaaatgcagccacagctcatgtgtaccaaagtagaaaaccaaatcacagagaaataaaaacatgcttcagagagaaaaaatgttttcatttcatgttgtaa

SEQ ID NO: 10452 - DNA, 3366 bp, Homo sapiens
  misc_feature (966)..(966): n is a, c, g, or t
ggtaattggcacggcgcgcgcgcaccccttccgcgcagccccctgacctgcagcctccggacctcgctgcagcgcggacccggcccgcccgcccgatccggggtcaccatgtggcccagctggaccccctgggcattctggatgcagacctggactcctttgtgccctcagacttgatcacaaccattgataaactggccttctatgaccttcaggaggctgaccttgataaggagttccagctgccgacaaccaccttcattgggggctctgaaaacaccctttctctgcgggagatcattcggcgcctggagaacacctactgccagcacattggcctggagttcatgttcatcaacgatgtggagcagtgccagtggatccggcagaagtttgagacccctggtgtgatgcagttctccagcgaggagaagcggaccctgctggcccggctagtgcgctccatgaggtttgaagacttcctggcccggaaatggtcctcagagaagcggtttggcctggagggctgtgaagtgatgattcctgccctcaagaccatcatcgacaaatccagcgagatggggattgagaatgtcatcttggggatgccacacaggggaaggctgaacgtgctggccaacgtgatccgcaaggacctggagcagatcttctgccagtttgaccccaagctggaggcggcggacgagggctccggggatgtcaagtaccacctgggcatgtaccatgagaggatcaaccgcgtcaccaaccggaacatcactctgtcgctggttgccaacccctcccacctggaggcagtggaccctgtggtgcaggggaagacaaaggcagagcagttctaccgtggagatgcccagggcaagaaggtcatgtccatcctggttcatggggacgccgcctttgctggccagggcgtggtatatgagaccttccacctgagcgacntgccctcctacacgaccaatggtaccgtgcacgtcgtcgtcaacaaccagattggattcaccacagacccccgaatggcccgctcctcaccatacccgaccgacgtggcccgggtggtcaatgcgcctatcttccatgtgaatgccgatgacccagaggctgtgatatatgtgtgcagtgtggcagccgaatggagaaacactttcaacaaagatgttgtcgtggacctggtctgttaccgccggcgtggccacaatgagatggacgagcccatgttcacccagccgctcatgtacaagcagatccacagacaggtgcctgtgctgaagaagtacgcagacaagctgattgccgagggcacagtcaccctgcaggagtttgaggaagaaattgccaaatacgaccggatctgtgaggaggcttatggcaggtccaaggataaaaagattctgcatataaagcactggttggactccccctggcctggcttcttcaacgtagatggggagcccaagagcatgacatgcccagccacggggatccctgaggacatgctcacccacatcggcagtgtggccagctctgtgcccctggaggactttaagatccacactggcctctctcgcattctgcggggccgtgcggacatgaccaagaaccggacggtggactgggcgttggcagagtacatggcctttggctccctgctgaaggaaggcatccacgtgcggctcagcgggcaggatgtggagaggggcacattcagtcaccggcaccatgttctccatgaccaggaggttgaccgcaggacgtgtgtgcctatgaatcatctctggcctgaccaggccccgtacaccgtgtgcaacagctccctctcggagtacggagtcctgggctttgagctgggctatgccatggccagccccaatgccctggtcctctgggaggcccagtttggggacttccacaacacggcccagtgcatcatcgaccagttcatcagcaccggccaggccaagtgggtgcggcataatggcattgtgctgctgctgccccatggcatggaaggcatgggcccagagcactcgtcagcgaggcccgaaaggttcctgcagatgagcaatgatgactcggatgcctaccctgcattcaccaaggacttcgaggtgagccagctctatgactgcaactggatcgtggtcaactgctccacaccggccaactacttccacgtgctgcgccggcagatcctgctgcccttccgcaagccgctgattatcttcacacctaaatctctgctgaggcacccagaggccaagtccagctttgaccaaatggtatccgggaccagcttccagcgggtgattcctgaagatggggccgcagcacgggcccctgagcaggtgcagcggctcatcttctgcacgggaaaggtgtactatgacctggtgaaggagcggagcagccaggacctggaggagaaagtggccatcacgcgcctggagcagatctctccattccccttcgacctgatcaagcaggaggcagagaagtacccaggtgcggagctggcctggtgtcaggaggagcacaagaacatgggctactatgactacatcagcccacgcttcatgaccatcctgaggcgcgcacggcccatatggtatgttggccgggacccagcggctgcaccagccacaggaaacaggaacactcacctggtgtcactgaagaagtttctggatactgccttcaatctccaggcctttgagggcaagacattttagagctgggcaaaacctgtgtaggtctcgctgtgggtttgctggggaccaagggggtgatgaaaaggggaggggcggagctcctgcccaagagaggggctgtggggccccaggataaaacagacacagtgacagggccaagagccagcactgctggccttggtgtcatgccagaatctaccaggactgagggagccagaggagtcctgtaggcaggctactgtgctggagcatcccccagctgctcccatcttgctggaatttcttgggcggcttctccacctgtatctcaagacagacacccgggggcctgtgtctgtggccgctcccatcccggcagccctggctgctgctcgccccaccctcgcttatctgtagattcaaagcgatgttctcttctgtgctcttagaagtagggagttcagcagtaacagccaggtgaagcgaacctgctgggtgatttgtttgcgctctgttttatggggcattcctgcgagatgtgtcagcttctgtatgaaatgcagccacagctcatgtgtaccaaagtagaaaaccaaatcacagagaaataaaaacatgcttcagagagaaaaaatgttttcatttcatgttgtaa

SEQ ID NO: 10453 - DNA, 416 bp, Homo sapiens
ttagcacatggacgatgctcaggaaatgctgctagacactgagcgctgaataagtttcataaatacctgcaagtattgcatcaggggatcaatagttaagatttaaaaaaattaacatgaattcgaagcaatataaaagtataattattctgagagagttttttcagttgaaactttgattacattttaaatgtgttttggatatttcttgtcttaggaatgtctttatcgtgaatctaatttttccagtgaattttgaaatacaaattcaattccacaggatgcaagcttctggatttaatttggttaataaattatctggtgatatcttcctttggtaaggtttggtagaagcatggcatgcaggaatgtgatgcactttaagtcttgtgttggttggatttcttaaaaaaaaa

SEQ ID NO: 10454 - DNA, 480 bp, Homo sapiens
agaccctctattgttgctaacataatttctgccagaaatgaagctgctaatttactctggaggagaaagcatagcttttctttaggtcaggtaaaaaaaaggacaagagagatgagatcagtgtattgaactttcctctgaattctttgcttttctttcctcaaataatgacagcccaagaatgccctttaactcccctggtataaatatcactgagtcttgtaaaacattgcttccctgaatcttagatatttgaggcaagaaagtaacttctttaatgttatcattaactttatatgtaagaaataaagccattttctgccaattggaaatacccatgattaaataaaacaagacacctttgacatgactagcctcctttgccatcaggaatcctgccgtttattgttttaatattgtttgttcttcagaaatgaagttaatagtgatcaaaaagaaaaattaaaatgtttaagctac

SEQ ID NO: 10455 - DNA, 609 bp, Homo sapiens
gtatgtgctacacaggacatttgctgggagaaatgatggtagtcttactgaaattctagatgcaaaacctatgtattcactggtgttcataatttagaatgtgactacacatgttaatacttactctaagtgttttactgaatttcccccccacatttttaaatgtttaaataagcattaaataaatttaaataagctttaaaagtcaaatagctagtagaagggcccagagtagcaaaaccagaaagagacacctgcttctcacatctgtttgttcagatgtctcttgacctttttgctagggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtggtgagtagaactggctttt

SEQ ID NO: 10456 - DNA, 12856 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgcaagtatgttttctgagttaaaataacacttttagatgagaaaatgcttgtatcatacagggctataatataaataaataaattgtatgtatgcaaaatttatcatattttctaccccttaaaaaattaagttagaaataagcttattttcttgcacatcaatatttttctgttggtaaagaggacacaatttctagtagattgttaataacatcaggaagatatttctttcgtcagaactaattgtgtgcttattcccatattctcagctcataactccctgttttggctgctctctttattttacaattgtttcattgcaaacagcaaggcagtatagcccacactcagccactagcccccagtccccaggactgagaatgagtggggaggctggggagttggtgagagaaggtggagatagggatttctgcttcccagtactctatcattagagaaaaggaggggtaaatattagctaagaagaagaaaaaagcttattcttcagggacccagtagattggacgtaagcaagtaaatattgcacaggcatcatgatgtaatagttgatggaccccagagatacccctcacccatgcagagaacaaagctgtgtggaagagcaactaccataagatggtgtgttccttccagcggctgttaaagccatcctgaataacaaatcagctattcctacctacagacccattccaatatgctgtgatacacgacacggtgcaccgcagaggagacagacatcttcagcacaaacacagatgcctgcaggagcttggcaagtcactaaattgcatgaaattgtgaggtgcacaccaaatgcagggatgggggaggccgtgggaagctctgtattctcaaaatttgacagctaattccggtttttagaaaatgcctgaggccagtagaggccctctagtcactcactgctgctgtttctgatataattattgagaaagctatctcacttaatagaagaaaacacgcactatcaaaaccagatagcctaacgtgcatgtgaaaatcgagaaagctgaaaacaaatccaggtacccttctctgaactggagtgtttccacagacttgaataatttatgaaattatcacaccagtatttctcatatcaccaagaagactttctctcctgcagtagaggattgttatatttgcctaaaaaacacgattccaatatatgacaagggcagataatttataagtgaatgttaataaaattggatgtgtataa

SEQ ID NO: 10457 - DNA, 11941 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttagacccattccaatatgctgtgatacacgacacggtgcaccgcagaggagacagacatcttcagcacaaacacagatgcctgcaggagcttggcaagtcactaaattgcatgaaattgtgaggtgcacaccaaatgcagggatgggggaggccgtgggaagctctgtattctcaaaatttgacagctaattccggtttttagaaaatgcctgaggccagtagaggccctctagtcactcactgctgctgtttctgatataattattgagaaagctatctcacttaatagaagaaaacacgcactatcaaaaccagatagcctaacgtgcatgtgaaaatcgagaaagctgaaaacaaatccaggtacccttctctgaactggagtgtttccacagacttgaataatttatgaaattatcacaccagtatttctcatatcaccaagaagactttctctcctgcagtagaggattgttatatttgcctaaaaaacacgattccaatatatgacaagggcagataatttataagtgaatgttaataaaattggatgtgtataa

SEQ ID NO: 10458 - DNA, 11693 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgcaagtatgttttctgagttaaaataacacttttagatgagaaaatgcttgtatcatacagggctataatataaataaataaattgtatgtatgcaaaa

SEQ ID NO: 10459 - DNA, 11446 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttga

SEQ ID NO: 10460 - DNA, 12797 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaacaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgcaagtatgttttctgagttaaaataacacttttagatgagaaaatgcttgtatcatacagggctataatataaataaataaattgtatgtatgcaaaatttatcatattttctaccccttaaaaaattaagttagaaataagcttattttcttgcacatcaatatttttctgttggtaaagaggacacaatttctagtagattgttaataacatcaggaagatatttctttcgtcagaactaattgtgtgcttattcccatattctcagctcataactccctgttttggctgctctctttattttacaattgtttcattgcaaacagcaaggcagtatagcccacactcagccactagcccccagtccccaggactgagaatgagtggggaggctggggagttggtgagagaaggtggagatagggatttctgcttcccagtactctatcattagagaaaaggaggggtaaatattagctaagaagaagaaaaaagcttattcttcagggacccagtagattggacgtaagcaagtaaatattgcacaggcatcatgatgtaatagttgatggaccccagagatacccctcacccatgcagagaacaaagctgtgtggaagagcaactaccataagatggtgtgttccttccagcggctgttaaagccatcctgaataacaaatcagctattcctacctacagacccattccaatatgctgtgatacacgacacggtgcaccgcagaggagacagacatcttcagcacaaacacagatgcctgcaggagcttggcaagtcactaaattgcatgaaattgtgaggtgcacaccaaatgcagggatgggggaggccgtgggaagctctgtattctcaaaatttgacagctaattccggtttttagaaaatgcctgaggccagtagaggccctctagtcactcactgctgctgtttctgatataattattgagaaagctatctcacttaatagaagaaaacacgcactatcaaaaccagatagcctaacgtgcatgtgaaaatcgagaaagctgaaaacaaatccaggtacccttctctgaactggagtgtttccacagacttgaataatttatgaaattatcacaccagtatttctcatatcaccaagaagactttctctcctgcagtagaggattgttatatttgcctaaaaaacacgattccaatatatgacaagggcagataatttataagtgaatgttaataaaattggatgtgtataa

SEQ ID NO: 10461 - DNA, 10973 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaaagacaggttgctcagatgtatacaaatgaatttattctcttgacctctagttcagatgtcaaaaatattttggtccccccaaccgcgaat

SEQ ID NO: 10462 - DNA, 12630 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatatatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagaattttggtcatggggtgaccctaaaacggctctgcaggactaaacttaaatgagacataatcagtgcaaagcaaccaacggcatgaaagatgtttgatttcattgtggcatgcatgtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgcaagtatgttttctgagttaaaataacacttttagatgagaaaatgcttgtatcatacagggctataatataaataaataaattgtatgtatgcaaaatttatcatattttctaccccttaaaaaattaagttagaaataagcttattttcttgcacatcaatatttttctgttggtaaagaggacacaatttctagtagattgttaataacatcaggaagatatttctttcgtcagaactaattgtgtgcttattcccatattctcagctcataactccctgttttggctgctctctttattttacaattgtttcattgcaaacagcaaggcagtatagcccacactcagccactagcccccagtccccaggactgagaatgagtggggaggctggggagttggtgagagaaggtggagatagggatttctgcttcccagtactctatcattagagaaaaggaggggtaaatattagctaagaagaagaaaaaagcttattcttcagggacccagtagattggacgtaagcaagtaaatattgcacaggcatcatgatgtaatagttgatggaccccagagatacccctcacccatgcagagaacaaagctgtgtggaagagcaactaccataagatggtgtgttccttccagcggctgttaaagccatcctgaataacaaatcagctattcctacctacagacccattccaatatgctgtgatacacgacacggtgcaccgcagaggagacagacatcttcagcacaaacacagatgcctgcaggagcttggcaagtcactaaattgcatgaaattgtgaggtgcacaccaaatgcagggatgggggaggccgtgggaagctctgtattctcaaaatttgacagctaattccggtttttagaaaatgcctgaggccagtagaggccctctagtcactcactgctgctgtttctgatataattattgagaaagctatctcacttaatagaagaaaacacgcactatcaaaaccagatagcctaacgtgcatgtgaaaatcgagaaagctgaaaacaaatccaggtacccttctctgaactggagtgtttccacagacttgaataatttatgaaattatcacaccagtatttctcatatcaccaagaagactttctctcctgcagtagaggattgttatatttgcctaaaaaacacgattccaatatatgacaagggcagataatttataagtgaatgttaataaaattggatgtgtataa

SEQ ID NO: 10463 - DNA, 7469 bp, Homo sapiens
ggaagtggatggcgtggagatatggcgcaactgcggcgcggacacttgacattcagggacgtggccatgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagaattttggtcatggggtgaccctaaaacggctctgcaggactaaacttaaatgagacataatcagtgcaaagcaaccaacggcatgaaagatgtttgatttcattgtggcatgcatgtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgcaagtatgttttctgagttaaaataacacttttagatgagaaaatgcttgtatcatacagggctataatataaataaataaattgtatgtatgcaaaatttatcatattttctaccccttaaaaaattaagttagaaataagcttattttcttgcacatcaatatttttctgttggtaaagaggacacaatttctagtagattgttaataacatcaggaagatatttctttcgtcagaactaattgtgtgcttattcccatattctcagctcataactccctgttttggctgctctctttattttacaattgtttcattgcaaacagcaaggcagtatagcccacactcagccactagcccccagtccccaggactgagaatgagtggggaggctggggagttggtgagagaaggtggagatagggatttctgcttcccagtactctatcattagagaaaaggaggggtaaatattagctaagaagaagaaaaaagcttattcttcagggacccagtagattggacgtaagcaagtaaatattgcacaggcatcatgatgtaatagttgatggaccccagagatacccctcacccatgcagagaacaaagctgtgtggaagagcaactaccataagatggtgtgttccttccagcggctgttaaagccatcctgaataacaaatcagctattcctacctacagacccattccaatatgctgtgatacacgacacggtgcaccgcagaggagacagacatcttcagcacaaacacagatgcctgcaggagcttggcaagtcactaaattgcatgaaattgtgaggtgcacaccaaatgcagggatgggggaggccgtgggaagctctgtattctcaaaatttgacagctaattccggtttttagaaaatgcctgaggccagtagaggccctctagtcactcactgctgctgtttctgatataattattgagaaagctatctcacttaatagaagaaaacacgcactatcaaaaccagatagcctaacgtgcatgtgaaaatcgagaaagctgaaaacaaatccaggtacccttctctgaactggagtgtttccacagacttgaataatttatgaaattatcacaccagtatttctcatatcaccaagaagactttctctcctgcagtagaggattgttatatttgcctaaaaaacacgattccaatatatgacaagggcagataatttataagtgaatgttaataaaattggatgtgtataa

SEQ ID NO: 10464 - DNA, 1792 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagaggcttatcaatcacaataatagatttgtcctgaaatgccagtcgttggaaagagaaacatataaatataatcatttaaaaatacacacatgatgtttatgatttcagtgttatatataataaaaattgatcaaaacaca

SEQ ID NO: 10465 - DNA, 395 bp, Homo sapiens
tatcaggcaccttgctcaagaggcaaaagaaggcaccaaagctgacttagaagttcttacctattacaggttaagtattatagacaatcttacaataattcccagtctcacatattaattgagaactggttctctgtagccactagttaggtatctatgaagaggcaattttaaaagtcatgtcagaactagggtagctgaaatatttagtattgtttaaaatattcaaaataaaagttaacatttatattttctgcatacaccacttgtaatttcctggtttctcactagcttggaattattgtgcagccaaaggctttgtcctcatattgagtagagtggaggcagatgagaggcatgttaggacctaggtgatggagttgagagggatatag

SEQ ID NO: 10466 - DNA, 287 bp, Homo sapiens
aaagaagagattttaccatttatctttgcagctattgttcctgatatagatgaaattgcagctcaggcagaaactatgtttgcgggaaggtatagtaacatttatatatctttatcttacttgtgaataacattttacttagaattctattgatactttgatattgttcactctatatctatttatttttagaccctctattgttgctaacataatttctgccagaaatgaagctgctaatttactctggaggagaaagcatagcttttctttaggtcaggtaaaaa

SEQ ID NO: 10467 - DNA, 1364 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatgatgcaagcttctggatttaatttggttaataaattatctggtgatatcttcctttggtaaggtttggtagaagcatggcatgcaggaatgtgatgcactttaagtcttgtgttggttggatttcttaaaaaaaaa

SEQ ID NO: 10468 - DNA, 12183 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgcaagtatgttttctgagttaaaataacacttttagatgagaaaatgcttgtatcatacagggctataatataaataaataaattgtatgtatgcaaaaaaaaaaaaaaaaaaaaaaaaaaaaaaaaaaaaaaaaaaaaaaaaaaaaaaaaaaaaaaaaaaaaaaaacaaaaaggaggaagcgacccaaacaacaaataacaacaacacacaacgagcggcgcaccagaaactcaaacgtccccagcaccacacgacacccccgacaccccaagccgcccccgccaccaacagtgcgccgcactcgctacccacaaccgcaaccgcgcccgcagcgcacaccctacaagacccacccctacgcccaacctccgacgacccacgcgccccttctggacgatagctcccacactacccctacgccaccccccaacaagccagaccactcactcacacgtcccttcgcatcactccactccctcctcctatcccatcacaatcacttatccgtgcattcacccacacacatcgccccgcgcacactgtttcctcccgctcttgccccccaaaacactatccctgcacctcac

SEQ ID NO: 10469 - DNA, 12973 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagaattttggtcatggggtgaccctaaaacggctctgcaggactaaacttaaatgagacataatcagtgcaaagcaaccaacggcatgaaagatgtttgatttcattgtggcatgcatgtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgcaagtatgttttctgagttaaaataacacttttagatgagaaaatgcttgtatcatacagggctataatataaataaataaattgtatgtatgcaaaatttatcatattttctaccccttaaaaaattaagttagaaataagcttattttcttgcacatcaatatttttctgttggtaaagaggacacaatttctagtagattgttaataacatcaggaagatatttctttcgtcagaactaattgtgtgcttattcccatattctcagctcataactccctgttttggctgctctctttattttacaattgtttcattgcaaacagcaaggcagtatagcccacactcagccactagcccccagtccccaggactgagaatgagtggggaggctggggagttggtgagagaaggtggagatagggatttctgcttcccagtactctatcattagagaaaaggaggggtaaatattagctaagaagaagaaaaaagcttattcttcagggacccagtagattggacgtaagcaagtaaatattgcacaggcatcatgatgtaatagttgatggaccccagagatacccctcacccatgcagagaacaaagctgtgtggaagagcaactaccataagatggtgtgttccttccagcggctgttaaagccatcctgaataacaaatcagctattcctacctacagacccattccaatatgctgtgatacacgacacggtgcaccgcagaggagacagacatcttcagcacaaacacagatgcctgcaggagcttggcaagtcactaaattgcatgaaattgtgaggtgcacaccaaatgcagggatgggggaggccgtgggaagctctgtattctcaaaatttgacagctaattccggtttttagaaaatgcctgaggccagtagaggccctctagtcactcactgctgctgtttctgatataattattgagaaagctatctcacttaatagaagaaaacacgcactatcaaaaccagatagcctaacgtgcatgtgaaaatcgagaaagctgaaaacaaatccaggtacccttctctgaactggagtgtttccacagacttgaataatttatgaaattatcacaccagtatttctcatatcaccaagaagactttctctcctgcagtagaggattgttatatttgcctaaaaaacacgattccaatatatgacaagggcagataatttataagtgaatgttaataaaattggatgtgtataa

SEQ ID NO: 10470 - DNA, 12919 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagaattttggtcatggggtgaccctaaaacggctctgcaggactaaacttaaatgagacataatcagtgcaaagcaaccaacggcatgaaagatgtttgatttcattgtggcatgcatgtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgcaagtatgttttctgagttaaaataacacttttagatgagaaaatgcttgtatcatacagggctataatataaataaataaattgtatgtatgcaaaatttatcatattttctaccccttaaaaaattaagttagaaataagcttattttcttgcacatcaatatttttctgttggtaaagaggacacaatttctagtagattgttaataacatcaggaagatatttctttcgtcagaactaattgtgtgcttattcccatattctcagctcataactccctgttttggctgctctctttattttacaattgtttcattgcaaacagcaaggcagtatagcccacactcagccactagcccccagtccccaggactgagaatgagtggggaggctggggagttggtgagagaaggtggagatagggatttctgcttcccagtactctatcattagagaaaaggaggggtaaatattagctaagaagaagaaaaaagcttattcttcagggacccagtagattggacgtaagcaagtaaatattgcacaggcatcatgatgtaatagttgatggaccccagagatacccctcacccatgcagagaacaaagctgtgtggaagagcaactaccataagatggtgtgttccttccagcggctgttaaagccatcctgaataacaaatcagctattcctacctacagacccattccaatatgctgtgatacacgacacggtgcaccgcagaggagacagacatcttcagcacaaacacagatgcctgcaggagcttggcaagtcactaaattgcatgaaattgtgaggtgcacaccaaatgcagggatgggggaggccgtgggaagctctgtattctcaaaatttgacagctaattccggtttttagaaaatgcctgaggccagtagaggccctctagtcactcactgctgctgtttctgatataattattgagaaagctatctcacttaatagaagaaaacacgcactatcaaaaccagatagcctaacgtgcatgtgaaaatcgagaaagctgaaaacaaatccaggtacccttctctgaactggagtgtttccacagacttgaataatttatgaaattatcacaccagtatttctcatatcaccaagaagactttctctcctgcagtagaggattgttatatttgcctaaaaaacacgattccaatatatgacaagggcagataatttataagtgaatgttaataaaattggatgtgtataa

SEQ ID NO: 10471 - DNA, 6191 bp, Homo sapiens
gcggccgcacgcgcccgctcccccgccggggtcccccgccgcccctccagcgccgcccagcgtcgcgtccccgcgcgggccggtgcggcggcagcagaggcttcccgggtggcccggcctcccgagggtcgccccgccccggcccagctccgcccccggccgctgctccctgattggccgcccccccacctctccagggctcctctcctcctcctcgcccaatgggcaccggcacctggtccaaaaattcccctgaggggaccgagggggctcggccacttccagctcccgccggcggctgtgacggccgcagcgggtcgcagagcagggagtggacacgagagtggggagcggagagggaaggaggaggaggaggagcaaaggtgttggagagaaaacttcagaaaggaacaggaaacctgccggggagcgcggcggcggctgcggcttctctgggcgcctgggctgcgctcttcgcggggtgtcccgagctggcgcttggccccggtctggcttccccggcgcgcaccacggctgagcgcgacgctcagtggctcgggccgtgcctccgccgtggctcttggccgctgtagtcccgcgatccgatccgcttctgccgcggcggctccctggagagagggcggcgagggcgcagggaagaagagggacgtccactgtggaacatgaagcagcatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccattctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcatgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacaggtacttgttcatcaatcatggggattacatttattattggtatttcttgtttacttgtcacagaaaccaaggaaaagtaatgtgtttcttttagctcttattactatctaaaaaaaaa

SEQ ID NO: 10472 - DNA, 480 bp, Homo sapiens
gcagggggctgttccttcctgtcgaggaggactttcaaaggtcttttgaagtggggtgtgggggaacttgccaacaggtattcatataatttgttatttctttaaagacaccttaattgaattactatggtcagatgggtaaactttccaaactttaaaagcactgacacagggaccttttaaaatgggtcatcttgatgagatctctgcccatctgttgataaccctaacagtggatgaaggctggggagggcaacaccctgcattcttatctgagcccttcagtgctattcagttccaaatgttttgatttgtttcaacaaagtctgtaatgttggagtgcccttagagcaattttcttcacaatcaaaatcacaatcctttaagtggttaataaatgtagttgccttccactcacttatgactctggacagtccccacccctgtcactcacaagggcagtcttcccaccccaccccc

SEQ ID NO: 10473 - DNA, 382 bp, Homo sapiens
gcagggggctgttccttcctgtcgaggaggactttcaaaggtcttttgaagtggggtgtgggggaacttgccaacaggtattcatataatttgttatttctttaaagacaccttaattgaattactatggtcagatgggtaaactttccaaactttaaaagcactgacacagggaccttttaaaatgggtcatcttgatgagatctctgcccatctgttgataaccctaacagtggatgaaggctggggagggcaacaccctgcattcttatctgagcccttcagtgctattcagttccaaatgttttgatttgctccaccatggctacaactgatccccacatcctgactaaacaccctcgctatctaatcagcacaaccc

SEQ ID NO: 10474 - DNA, 310 bp, Homo sapiens
ttaaaccatgaaatgccaggtctctcccacagaatttctgaggcccgggatgcagcctggtaattcatgtttcaaacaagttcccattcgatgctgagcctgagtgattactcagaagcactactctacaacgatcactaaaaaaaaggcaaaaacagaaaccataataatatcaacaagtataactaaaagccattagagaattataacgaaatgtcaaatttcaataatattattagccaaagaaagtggaaaagaggaacagaggaacaaaaaccaaaaaaagagaactagaaaaaaataaaacact

SEQ ID NO: 10475 - DNA, 350 bp, Homo sapiens
gaaacagctcaccagacaccaaatctgctagcacctttatcttggacttcccagccctcagaagtgtgagaaataaatttttgttgtttataagccttccagtctatggtaatttgttgtaacagcttaaactgttagagagttttcaagcttgaacacaggcatctttttatttgcaagctgttatatttgttcctataaaagcttaaacacagacatttatgaaaagcctatagctaacattattctcgatagtgaaagactgtatcaggaacaagataaggatgcccatcctgaccatggctattcaacattgtactgtaagttctaaccagaacaactaggcaaga

SEQ ID NO: 10476 - DNA, 735 bp, Homo sapiens
gaaatcaagtattatttccccaccaatattcatatccaaaaataactttaaatacacacacacacacacacacacacacttttagtgaactggttgaatgaaaataaatttatataattattttatataacaaatcagcataaaatggaaaatcaaactgcctctctagatataataaccttcactgactgtggaaatacatggatagctttttaaaatcttcagtgttggagtaacagtcccttacatcttttcagcctcttgagtacaagaagactatcataagagttagttccagattggtgcaagactggaatacacttgactgcttttattaaagccatgagggcataccaagtaattcacccagtatggtcttattgccacccttgaaaatccctgggcatggtccagtccacatagaatgaattcagaaaggtgtctcttgttggtctctagaactatcctcagaaataatagtaaaacagtggtcatgagtagcctcactaggctacttcatgtacattatcttgtttactctctatagcaaccatatgagatgtatataattattaaattgtacagatgggaaaattgaaattcagagagattaaatacaatgcttgctctgtgttacactgttagtaagagagcaatacatgaacccaagtttgatcctcaaaatcacacttttaattacttgatacataatgtcttccaatattgaatctagac

SEQ ID NO: 10477 - DNA, 279 bp, Homo sapiens
tatctgacagctgctagtttttccctcatgatctttctattaaaatagctctgtacttactatgttgagcccttcctttttttttgacagggtctcagactagagtacagtggtgtgatcatggctcactgccacctctgcttcctgggttcaagtgatgctcccatctcaacctcccaagatgctaggactacaggcacatgccaccatgcctggctaatttttttgtgttttttgtagagacagggtttcaccatggtgcccaggctagtctcaaac

SEQ ID NO: 10478 - DNA, 421 bp, Homo sapiens
aacattctatggataagggatcctgatatttttactttctttggagctgtttccttttaaaacatgctgggatacaccttgagaggagggctgaagtcagagatgaaggtgcaagtgcaaaatgcagcatcaaagacattggcagaatctgtgcttggtcacttaccttagcgctgagtccaaggcacattctgatttaaaaagtaggagaactagaactcctttggaggaaggagaaatagggaagaggtagggcctgtggtgagagcaatcagagcagcagtgcagacaaggaagccagaccaagggtgggggaagctcagtctggaatgtgctagtgaggtccccccatacatggcagtagatgccaacatgatggctgagaagaatatgaggaaaaacagtcagaaatgtgtaagag

SEQ ID NO: 10479 - DNA, 497 bp, Homo sapiens
tagaggctttgaatacttgcagatggaccggttggctagtgatgggagaaaagattttatattaattatttgattaaaaacctttatacagaaaaattgacttcttttgttgtacagctgatgaatttcagcacatgtatacatttgtgtatctaccaccataatcaggatatagtttttttgttgttgttgttgttttgagacggagtttcgctcttgttgcccaggctggagtgcagtggtgcagtctcagctcactgcaacctccgcctcctggattcaagcgattctcctgcctcagcttcccaagtagctgggattacaggcatgtgccaccatgcccggctaattttgtatttttagtagagatggggttttgccatgttggtcaggctggtctcgaaccgctgacctcaggtgatccactcacctcggcctcccaaagtgttgggattataggcatgagccactgcgcccggccaggttttttaatttcc

SEQ ID NO: 10480 - DNA, 1313 bp, Homo sapiens
  misc_feature (533)..(533): n is a, c, g, or t
tcctgcctcagcctctcaaagtggtgggataacaaaagttttttttttgctttttaaaaaattcaatgttagcaagagaatgataagtttgggagcttcatatgatgctttagaagtgtaaatttcctttctgataagcagctaagcaagctatatcaggaatgtagctttttggttgttttttgagatggtcttgcgttgttgcccaggctttgagtgcagtggcatgatcatggctcactgcagcctcaacctccctgactcaagcgatcctcccacctcagcctcccaggtagctgcgactacaggcacgcaccactccactcggctaattttttattttttatttttgtagagacagggtcttcctatgttgcccaggccagtctctgaactcctgggctcaagtgatccttctgccttggctcacacctataatcccagcctcccaagtagctgggactacaaggcacctactgctgcacttagctttatcttttaactcatattttaaatgtcttctacaaggcacngaaaaataagtagttgtgttcatttttaagtaaatagtagtaaacagtttcaaatgctgtttgagatgttaattaaggcacacacttagactagtccatttgatttgaaaattaggattttatttgtgctttttgttaattactggcttttaaaagatcagtagtggggcagaaactagactagtgggttgaagggtgaataggaaataagtaatacttattctttcaaggagcttgactgaaaaggagacagtggtagtttgaagatattgctgtttttaagataaaaatgatttcagcactttaaaaataaaaagttggaaatgatcaatgaatcaaggatcatcaagaaagaggcaagaggaagtaagattaagcacaaagagtatcaactgataggtggcatttcaaggaacttcaggtgttgaatatctaaagcaccaaatgcgtgtggacagcagtgaagataaagctggaaatgcgccggcagaccaacacatgatgagccctgtaggtggtggacaaagactatgagcaagccatttaggcaaacatctgaagaatttaaaaatcaaaggcaaacaaataggactgtttcattaagatcacttgcattctaacaggttatgatgaatggaaagctgatggttcctggttggaaaaaagataattttcaatttggacatgtcacatttgagatgcagttgacacacccaagatacataatatattgtctttcaaaattcagaaacctaataaaccatgatcttaataaccgcc

SEQ ID NO: 10481 - DNA, 340 bp, Homo sapiens
tatatatatatatatatgtgtatgtatgtatgtatgtgatggggtgcaggaaatactaccccagcagcttccaattgtgcttacaataatatagtctcccacttgtctgtatgctctataaacatctaaaccttatctctttgatacagttcagtgccaagtataatgctaggtacatagatgataaacatgtatttgttgaatgagtgaaccaataattgtcatttttttcaagtgctctgtagtaaatactcagtttacaggaaaagtatttcctaatagttcttcaacagatggcactgtttgttaaggaatctaaggataaaagaaatcatgtaat

SEQ ID NO: 10482 - DNA, 576 bp, Homo sapiens
agcttaaaggagggacgtttctcaatgtgaagtctttctctatttcaaatataagcacaaaaagtaatgatggaaaataatgcgaattggtgtgtccagggtcagctggccatcctgtacacaggcaggtggggacagacgagccaaggatgagaggtgacagggcccgtatctgaccccgtcactgcctgacttggtaatattttcagaatccaaagctttctctgtccctatttctgagcttgtaaagggtagctaatagcagttgtttgttgagttctgatgagaacaataaagatttgcagagaaaaccctgaaaagtgctctaagctcttggacataaccatcacagaaatgtgttttgttattttgctcaatgcagcaaaaaccctccatcctttgcttcctggtgtaaaaggttatatgtgatgctggagtgccaaagtacttggtgtatttcaacagtgcatcaagttatcaccacctctggtgctttggaagatgctgtgatttggaaagcactgtcgaaatgtaaaacattattgccacagtagtaaaaatatccgtgtccatctc

SEQ ID NO: 10483 - DNA, 301 bp, Homo sapiens
ggcggcatcaggtctccttcaacttctgttttacatggtctgtttgcagttgagtcagtcacctatttaaaccttatttcaaacaacgcaccagtcaataatataaaattcacacaataaccaacttggttgcccttcaagaaatacacagggaaaacaactggagtttttaaacgtaaagttcacttcctcattctttcactctctaaggaagcaggacaaattcttgccccagtacaaagtcctgaccttgatgaatgagattcattcccattaggtggcaggttccactcagcgcctc

SEQ ID NO: 10484 - DNA, 729 bp, Homo sapiens
ccaaagagccagacaaataacttaatgatttaaacatattgcttcccacataattcactgtattgacaggaaggttgtagttttgtcgatcataaacaccgttttgagattaatgctacatggtgttttaatttgggttccaccaaaagaagaccctgagacaaggatttgtttggttccaaatagttcatttaagaatgttgaagaagtaggaaagagacagggaagggacaaaagttaataagcgtgctttaataagtagtataccacactgggcaactggtcatcagtctcgctgaactccctctgctaggattacataggaggaatatggcctctgggattgtcccattgagggataagacatttactacctcttgcccttcactggttgaagtttctgggaataactcccaggctctcttgcttgtcctgctgccaagctgagtatgctccttcaggcagagaaagctctggcagagaggctcagatgctgagaaattgtctggagaactgttcatagaaactgcaggtgttctccacactggctgtgaatggaaatgggtgggacattgatagattcagctatgaatggtgaaatacattgtatattctcaaaacaggtgaatttttcctttgattttgattaaaattcccatatattggtagagcagtgtaagtacctaccctaaccatgccgctcccacgctggttcactttatttgcttt

SEQ ID NO: 10485 - DNA, 382 bp, Homo sapiens
gactttaacatgccactgacaacactagataggtcaagacagaaagtcaacaaagaaacaatagacttaaactataccctagaacaaatggacttaacagatatttatagaacattctacccaattctaccgtagaatatgcattctattctttagcacatgcaacattttccaagatagcccatataataggtcacaaaataagtctcaataaatttaagtaaatcaaaatcatatcaagtattctttcagaccactgtggaataatatctgaaattaactccaaaaggaaacctgaaaaccatgcaaatacatggaaattaaataagctgctcctgaataatcattgggtcagtaatgacatcaagatggaaatttaaaa

SEQ ID NO: 10486 - DNA, 866 bp, Homo sapiens
gccttacagtctgtttgaggagggaaagagagagaggagaaggagacaggcaggataggtcaggttctaggggctcccatggtttgtatcttaacaatctaccattttcttttcaggccagtgtccacatcctgctcacatttgggacatctgtgaggcagggtgcctcctttttgtccctccaagaggacagttgggggacttggcctctggccgcctcaagttgggtcagcacctgctgggcctcatcctggttcatcgtgcatcaatgggagcgcacctgggttctgctgacatgtgagagcttcttcaccgaggggttcagaaaagtgtgctcatggcctgtagatctggattcaaagggagatgagaaaaataggaactgagcccgtggcttgcctcacccacttcctgagcctgcgcaagggacaagactttcctgtgtggccttcttacggcagtccacagggaagtggcctcattttctgtgtctgtcctgcccagcgcccccactctcctgtgctggtcccaggccatcccttagccagagtgcagaactccagacccccaatattctctcatatcctcagaatcttcagcttccatccatggatgttggctgaatcctgagtggggtcgtagaaagatctggtcctgtgagtaggggggcgaggaggaaggcagggacttcagctgggctgtctacaacctgagtctaaaacacctaaagacaagcacaacttgcccccgctaggacgaatttcttgctccagaccgcctcactgcatctctagggccatgtgtattcctgctatttggccacattccttgagaaaaattgcctattaaaagaatttccttattca

SEQ ID NO: 10487 - DNA, 812 bp, Homo sapiens
gccttacagtctgtttgaggagggaaagagagagaggagaaggagacaggcaggataggtcaggttctaggggctcccatggtttgtatcttaacaatctaccattttcttttcaggccagtgtccacatcctgctcacatttgggacatctgtgaggcagggtgcctcctttttgtccctccaagaggacagttgggggacttggcctctggccgcctcaagttgggtcagcacctgctgggcctcatcctggttcatcgtgcatcaatgggagcgcacctgggttctgctgacatgtgagagcttcttcaccgaggggttcagaaaagtgtgctcatggcctgtagatctggattcaaagggagatgagaggacaagactttcctgtgtggccttcttacggcagtccacagggaagtggcctcattttctgtgtctgtcctgcccagcgcccccactctcctgtgctggtcccaggccatcccttagccagagtgcagaactccagacccccaatattctctcatatcctcagaatcttcagcttccatccatggatgttggctgaatcctgagtggggtcgtagaaagatctggtcctgtgagtaggggggcgaggaggaaggcagggacttcagctgggctgtctacaacctgagtctaaaacacctaaagacaagcacaacttgcccccgctaggacgaatttcttgctccagaccgcctcactgcatctctagggccatgtgtattcctgctatttggccacattccttgagaaaaattgcctattaaaagaatttccttattca

SEQ ID NO: 10488 - DNA, 1600 bp, Homo sapiens
ttcactcacctaatgtttccaaatggcatggaaagtcaagacgacttctggattcatggacatctggtcactggaggccttggctggtggtactcaaagacaatcagaatgcgacatcagctttgttcaagcagagattctgagtcaaatcactcctctggcccccaataccaggatggggcctgtcttagctgggccccactttacatctttgtgacttttgtcagctcacccccagcctggtgccagcccagtatcagttgtagggaaatctggtaacatttctactagctaacacgtgtccagtgcttaccacgccctaggccctgagctacccaataactgtgttctttggttctcaccacaaccctatgcacagaggaaatggaaggcacaaagtggtgaagttgcttgcccaagaccccgtagctggtatgtggcagagcataaatgcaaacccagttcttctggctccagaatcctgccctagacgatgacacttttgatcagcagtggatgcaccccaaatcatgcctctgttattgaccaaagcctgatccactcacccttgagtttgaggcccactgtgaacctgcccagaaatgcctacctccaagccctttcttcctccactgctcccacccagccaaagcagacaggcagctgctcccccagaaccacttcctacttcctcatcactgctgatacggttctccctttagggatgctcttcccctaagatctgcctctaagattccactcaagggagcctccttgataccccaggtggaaggggtcactccttgagcaccaagtccacccccatcacaggaccctctgtgtgaccttctagtattgtttatggttgtgacctcactgccctaagactgtctacttctgaccccacaagggctagcactgccctcagaaagctcagccactgtttgctgaatttaattaaaaatacatctctaataacctctttgtaaaatagcttggcagtttcataaaaagttaaacgtacatcttcttcacgagccagcagttgtactcctaggtatattcctacgggaaatgaaagcacatgtctgcataaaggttcatgtatgaatattcacagcagcattattcataacagccaaaacctggaagctgtcaagatacccatccactgacgaatgattcagcacactgtggtatagtcataaatggaatactactcagccatgaaaaggaacaaattcctgataaacaccacaacatgaatgaattgcaaaagcagtgctctgagtccaagaagctgggcagaaaggagttggtgccctgattccatttttctcaagttgtagaagaaacaaactaatctacggtaggagaaattcaaattcagattctccccatccccaccagttacctctggttggtggagagggggagaattggcaggaaaggggcacaaagaaactttttggggtgatggaaatattttgtaccttgctttagatgttggtcagatggaatatacgtttgtggaaacctgccaaactgtacattgaatatctgtgtgtttttaccacatacagttaaaactaaaaaaaaa

SEQ ID NO: 10489 - DNA, 380 bp, Homo sapiens
gtcgacccttgtctttattcatgggtcctgcatggtgcccaaacctagtaggccttaaataggtgtttgctaggggctggcagatgagtgagtctatattttaatagtttaaaggcctgtatagggaaacctaccttcagttatttaattcagcactttttttttttttttttttgagacagggtctcaactctcgcccaggctggagtgcagtggcacgatctcagctcactgcaacctctgcctcccagattcaagacatcctcccacctcagcctcccgagtagctgggattccaggcatgcgccaccactcctggctaattttttgtatttttagtagagacagggttttgccatgttggccaggctggttgaact

SEQ ID NO: 10490 - DNA, 1247 bp, Homo sapiens
actaaggtgcacaagaatgtctgtaaactacctgaaggtttgtagatatggagtacaccttacccattaatcaagctatgcacagcttgaacctgggaggtggaggttgcagtgagcagagatcacaacattgcacttcagcctggtgacatgagcaaaactgttgtctcaacaaaatgaaattatggaacctgtttgccatcctagtatttacttaattgttccttcttaacatcaaagatggtcttctaggcaattgtaaattttaaattagccagttattttgacaattaattttttactccacctgtatctttagtgcccagccaatgatctggcatagttaggggtgcaccaagaatgtctgtaaactacctgaaggtttgtagatatggagtacaccttacccattaatcaagctgtgcatagcaggaaccaatacgagccgtgatcctcctggttcatacagaacaatggaaaaacataaggctttgtctacctagttggccatcagactttcagcaacttttatcatccagatagtcaccaaatgaaataaaatagaaaaatcccttgagcaatgaaacaattgtgaatgaacacaaagtccatgaatttaatccttatccgtttgctgagccaagcatgtgcatctgcagtgggtggcccaggctggcagcacagataccaccatttcccttttctttgctcagggcatggcctgtttatctcgttgcaccagatgagggttggaaggatgatggtggtggttgtttcagatctactgacagcaatgagaaatcaatgacagttgacaggaagagaggacgcatacaacaggcaaaagaggaatgcccagcagtcttggtccttgcggtgcaatactggccttgaggccaagtcagcaggggattcgtagtcactaacttctaactgaggcagggaagtaacatgttctggaaaaggtccaaagaaacaggaatagaggcagtgtagcaagaggcagatttttggtgccaaatagatttgaatcctggttctgcttcttcctttgtagagtatgatattggttctttcctcccaaagctattataaagactaaatatgtacacaaatctttgggatgtctgacatataaatgcttaacaataggtatttgctggtattattacaaatgaatttgcttatttttgagccacttctatgtctgtccattaaaccaaaatgtgttctgcaaaaaaaaaaaa

SEQ ID NO: 10491 - DNA, 369 bp, Homo sapiens
cggtgcccgatgctttccacggattacctcgtatactcgtcatacccaccatttgagtgaagtgcttggattcccatttgacagatgaggaaactaagggaccgagaggtgaagtgggtcccccaggtcacagagtggtgattggttgaatatgggcttggatccagggggcgggggtctcgtgtcccttccctcagccatgtcagcccctcactcactcgggtgtgtgttcagggatgggcctgcacggactctgtttcttggctggggctccctctgttcaccccaacctgcttcctgccttccagggtgacagctctggctgagtgcgttgcgtatgtgctctgtgccaggcatgtggagaccgag

SEQ ID NO: 10492 - DNA, 381 bp, Homo sapiens
agtcactggagcctgagcaacatagtgagaccctgactccaccaaaaaaacgtttaaaaattaaccgggcatggtgctgtgttcctgtagtcccagctactcgggaggctgaggaaggaggatcacttgagccaaggaatttgaggctgcagtgagctgtgatcacgccactgcgttccagcctgggtgacagagcgggattctctcagaaaaaaaaaaaaaaaaaagacagaaaagaaaagaaaaaaacaaacactggaacaacaataggaagagtcctttagggatgacagaactttccctactctactctaagcagcctaggctcccggctctgaagtttaggctcccacttggtttagaaataaaaaacccaaaaca

SEQ ID NO: 10493 - DNA, 540 bp, Homo sapiens
gacaggctctggagcaagagtgcttgggttcaaatccctgttgcaccagggatgagtgatatgcttttgggtagattatttatttaacctctccatgcatagcttcattatctgtacagtagggataatcagtacctatctcacaggttgctgtgaggcttaagtgaattcatacataaaagtgcttagagcagtgcctggcagtggaaagagctcagtacggtcatccttgatcataaggaggatgactatattgactttggagaacttgtgctcagggatgaaggtcaaggtaggatccaggagatatttgcagagacatgtgagttggttctgttctactacagctaccagtgccaactggaagtcatcccaccgtcatttataacacctagaaagtgtgagtcgacaggtatgctctccaatatggtggccatgtggttactgagcccctgaaatgtgacaagtctgaattgggatgtgctgtaagcatcagatacctatgctaaatttcaaagacctagtttaaaaaaattaaat

SEQ ID NO: 10494 - DNA, 391 bp, Homo sapiens
catataatctccacggtatctttctcagcattaggaggaatggattttaaaatattatataaaaacaagaaaagactaaagcagtacctgttacagataacattctgaggaaaaagaacatttggacttgctaaaatgtttttgacatctacattgaggacccaagaaaatgattttctttttaggtttggtttcagttatcttgtgctaaaaatgtctgtgaacattaaatttctttgatctttgtctacgtagctatcacactctgtaataagtctttaattatatgtttttggcactgcacctggtaggtgagaaggactgttgcatttctgttgttcactcatcaaatagcaattacccttcaactctccttacccctgttactgtg

SEQ ID NO: 10495 - DNA, 431 bp, Homo sapiens
cttatggacatcacttgccctcctatgtgatacactgagaaagatacggcattgtgtttgtgtattcctgccaaagccacagcctcagtctaatcattagaacacattggacaaatccaaactgagaaacattctaccactggcctgcacttttcataaatgtcagtgtcatgaaagacaagactaagggacagttccagatgaaaggagaccaaggagacaggctgctgtgtacatcgtatgggcataaatcggacgtggggtcaaaattatttttctaaaaacaatattattgagagggctctgtgcagtggctcatgccggtaatcccaacgttttgggaggccagggcgggaggattgcttgaagctaggaggagttcaagaccagcctgggcaatatcgtgagaacccccatctacaaaaaaaaaa

SEQ ID NO: 10496 - DNA, 468 bp, Homo sapiens
tgagaaacctatgtctcccacatcctctgtatgtctagtttggttgaagtgttgcaaatgaattataaatatgttgttgtctgaaaagaaatcatggctgttagaaagaggatgtgggccagatgtggtaactcatgcctgtaattccagcagtttgggaggccgaggtgggaggattgcttgagcccaggctgttcccaaattttggtctcaaatggttctcctgtcttggcctcccaaacctctgagattgcaggcatgagccaccatgcccagccagataacaaacacctttaagtttgacattcatcattattgtaaacttttatttccttttaagacttaaatattggtgtttaaaaatgaaaataaactgaaatgacatattgtcttttccaatgaacaaaataaatgtgataatattcaatttgtacattgatttgaataaactggtgtataatttcacga

SEQ ID NO: 10497 - DNA, 2223 bp, Homo sapiens
  misc_feature (1211)..(1211): n is a, c, g, or t
gcgagccacggcgccgggggcggccaaggggaggcgggatgagtctgcgagccggctgagcgcgccgaggagccggccggggcaccgccggggacatggcgtcttggctccggagaaagctgcgtggcaagaggcggccagtgatagcgttctgcctcttgatgatcctatctgcgatggctgtcacccgctttcccccacagcgtccatccgccggcccagaccctggtcccatggagcctcagggggtaactggcgcccctgcaacccatatccggcaggctttgagctccagccggaggcagcgggcaagaaacatgggcttctggagaagccgtgctttgcccaggaactccatcttggtctgtgctgaggagcaaggccatagagcaagagtggacagaagcagggagtccccaggaggggacctcaggcatccagggagggtgaggagggacattactttgtcaggacatccaagactcagtactcagcatgttgtgctcctgagggaggatgaggttggagatccaggaaccaaagacctgggccacccccagcatggcagtcccatccaggagacacagagtgaggtggtcaccctggtcagtccactcccagggagtgacatggcagctttaccggcttggagagctacttctgggctgacactctggccccatacagcagaaggcagggatctgctgggagctgagaacagagccttgactggtgggcaacaagcagaggatcccaccttggcctcaggggcttatcagtggcctggctctgttgagaagctgcaagggtcagtatggtgtgatgctgagacgctgttgagcagctcgaggactggtgggcaggctcccccatggctgacagaccacgatgtgcagatgctccgtctgttggcacagggggaggtggtggacaaagccagggtccccgcccatgggcaggtgctacaggttggcttctccactgaggctgcccttcaggacctgtcctctcccaggctcagccaactctgttcccaagggctctgtggcctgatcaagaggcctggggacctgcctgaggtcctgtccttccacgtagatcgtgtgctggggctgcgccggagcctacctgctgtggcccgccgcttccatagccccctcctgccctaccgatacacagacggtggagcaaggcctgtcatctggtgggcncccgatgtgcagcacctgagcgacccagatgaggatcagaactctctggccttgggctggctgcagtatcaggccctgctggcacacagctgcaactggccaggccaggccccgtgcccgggcatccaccataccgagtgggcacgcctggcgctcttcgacttcctgttgcaggtccacgaccgcttggatcgctactgctgtggcttcgagcctgagccctcagacccctgtgtggaagagaggctccgagagaaatgccagaacccagccgagctgcggctggtccacatcctggtccggagcagcgatccatctcacctggtctacatcgataacgctggcaaccttcagcaccctgaggacaagctgaactttcggctgctggagggcatagatgggtttcctgagtctgccgtgaaggttctcgcatcagggtgtctacagaacatgctgctgaagtcgctgcagatggacccagtgttctgggaaagccaaggcggagcccaggggctgaagcaggtcctccagaccctggagcagcgaggacaggtgctgctgggacacatccaaaagcacaacctcacactcttcagggacgaggacccataagccgcacacagccctgagtcaatgagcatccatcctgatggccacattttcttgggctcactcatcttgaggacaaatgggaaaagccagaagccagaggggcacaaggatgtcacgggatatttcacctgcctgggatggtggaggtagtatggggttttcaatctcaaagcgtccctttctgccttctcggctctggctatttattcccttgcaccaacaaatacattcgaaaatgttctgtgagctgctcaagaaactgtaaaaatgtgtgatgcacgtgcatatgcagagtgggagaactttgtgtgtgtgtagaggtgtgtaggtgtgggtggcatgtgtgcacgcctgcatgcaatacctgagaccaacctaataaaggtacaatcttcataga

SEQ ID NO: 10498 - DNA, 365 bp, Homo sapiens
tccggagcagcgatccatctcacctggtctacatcgataacgctggcaaccttcagcaccctgaggacaagctgaactttcggctgctggagggcatagatgggtgagggtcaaaagggttgggtggaagttcatgggactgagacctgatggccttgctgcaaaccttgggaccttcaactgtggccctgagaagcccacagtccatcagacagaagttattggatcagaactttaggcggtggtggggagccctgggaaagctgagaggggatacagttggcagggcctaccccaatatccagagggcctcgtgcctgcagaatactagctgtattgctggggtgtgggaaggctagtccttc

SEQ ID NO: 10499 - DNA, 417 bp, Homo sapiens
cgcggccgcgggtaggctccctcagatccccgtagatctcagtagatccggcgtgtattccccacccgcggagtatcccggtgtgcagcgatctcccgagagttggcgcagggccacttggctgcagagaacgtgtgcaccttcagtccgggaaacccgccccagccgagtagccgcgcatcctgggaagcctggcgagccacggcgccgggggcggccaaggggaggcgggatgagtctgcgagccggctgagcgcgccgaggagccggccggggcaccgccggggacatggtaggactcgcgggaaggaacgcgcgagcggagggtggggcgatcaccaggacaggtggctgcagtcaacgcgcagcggcccagggcgcgcgcagcctgcgcggcctcccgaggccggagttgtt

SEQ ID NO: 10500 - DNA, 3120 bp, Homo sapiens
  misc_feature (1211)..(1211): n is a, c, g, or t
  misc_feature (2917)..(2917): n is a, c, g, or t
gcgagccacggcgccgggggcggccaaggggaggcgggatgagtctgcgagccggctgagcgcgccgaggagccggccggggcaccgccggggacatggcgtcttggctccggagaaagctgcgtggcaagaggcggccagtgatagcgttctgcctcttgatgatcctatctgcgatggctgtcacccgctttcccccacagcgtccatccgccggcccagaccctggtcccatggagcctcagggggtaactggcgcccctgcaacccatatccggcaggctttgagctccagccggaggcagcgggcaagaaacatgggcttctggagaagccgtgctttgcccaggaactccatcttggtctgtgctgaggagcaaggccatagagcaagagtggacagaagcagggagtccccaggaggggacctcaggcatccagggagggtgaggagggacattactttgtcaggacatccaagactcagtactcagcatgttgtgctcctgagggaggatgaggttggagatccaggaaccaaagacctgggccacccccagcatggcagtcccatccaggagacacagagtgaggtggtcaccctggtcagtccactcccagggagtgacatggcagctttaccggcttggagagctacttctgggctgacactctggccccatacagcagaaggcagggatctgctgggagctgagaacagagccttgactggtgggcaacaagcagaggatcccaccttggcctcaggggcttatcagtggcctggctctgttgagaagctgcaagggtcagtatggtgtgatgctgagacgctgttgagcagctcgaggactggtgggcaggctcccccatggctgacagaccacgatgtgcagatgctccgtctgttggcacagggggaggtggtggacaaagccagggtccccgcccatgggcaggtgctacaggttggcttctccactgaggctgcccttcaggacctgtcctctcccaggctcagccaactctgttcccaagggctctgtggcctgatcaagaggcctggggacctgcctgaggtcctgtccttccacgtagatcgtgtgctggggctgcgccggagcctacctgctgtggcccgccgcttccatagccccctcctgccctaccgatacacagacggtggagcaaggcctgtcatctggtgggcncccgatgtgcagcacctgagcgacccagatgaggatcagaactctctggccttgggctggctgcagtatcaggccctgctggcacacagctgcaactggccaggccaggccccgtgcccgggcatccaccataccgagtgggcacgcctggcgctcttcgacttcctgttgcaggtccacgaccgcttggatcgctactgctgtggcttcgagcctgagccctcagacccctgtgtggaagagaggctccgagagaaatgccagaacccagccgagctgcggctggtccacatcctggtccggagcagcgatccatctcacctggtctacatcgataacgctggcaaccttcagcaccctgaggacaagctgaactttcggctgctggagggcatagatgggtttcctgagtctgccgtgaaggttctcgcatcagggtgtctacagaacatgctgctgaagtcgctgcagatggacccagtgttctgggaaagccaaggcggagcccaggggctgaagcaggtcctccagaccctggagcagcgaggacaggtgctgctgggacacatccaaaagcacaacctcacactcttcagggacgaggacccataagccgcacacagccctgagtcaatgagcatccatcctgatggccacattttcttgggctcactcatcttgaggacaaatgggaaaagccagaagccagaggggcacaaggatgtcacgggatatttcacctgcctgggatggtggaggtagtatggggttttcaatctcaaagcgtccctttctgccttctcggctctggctatttattcccttgcaccaacaaatacattcgaaaatgttctgtgagctgctcaagaaactgtaaaaatgtgtgatgcacgtgcatatgcagagtgggagaactttgtgtgtgtgtagaggtgtgtaggtgtgggtggcatgtgtgcacgcctgcatgcaatacctgagaccaacctaataaaggtacaatcttcatagaactgcacttgcagcctggagttgctctggctgaaagtagactcaggcttaagaaatgaaacataatgcgtttgtctttatagactttaaattttcaattattactcagttatgtttttggtttaaaaaattataaaagtctaaaagtaatacatgctcagtaaaaacaagtccataaaaaatagaagcatatgacaaaaagcataagtcccacaaactccctagcggtgtgtatgtgtgtgtgtgttattcatggtcacactacatgcaaattaaaaaatgaaagtgtggtcatgctttgtcaactcactatatttttactttattaactatattctgtatcagccatctgaattgacccaatctttattggtgactgcatgaaattccaaggcagggatgtgtcatattttctttagctggtcccataatcatgaacatttaagtagctccaatttttcatcaattacagacattgccgccatgaacatgattgcatggcgtgcaagtatttctgcgaggtagatttccgtacgggatttctggggcaaagggtatgggcattcagtattctgagagaaactgccaaattgctctctgaaatggtggtgtcaatttacatttctcccaagagggtaggagactgattatttttctacaccttcaccaacacttggcattctcagacttttggnttttttttggcctatttaggaggaaaaccgattttaaaagctgcatttccttaatcatgaatgaagtcatctttccacttatttgccagacatttgtattttcttttctgcattgtctttttgttttaagatgtttgccctttgcttgttaatttgttggaaatctttgactctaataagtgtgatcaatcttttctctgctg

SEQ ID NO: 10501 - DNA, 350 bp, Homo sapiens
cctggccaaggtactctgatttaattggtctggggataggccccaggcatgggcaatttttaaagccacccagatgatttgaatgggatggctagagaaccactaagctagtatgtaaaatgatacatttaaagatatatatatatatatatatatatatatatatatatatatatatatgtatgtttgccccaaagccatttgtcttttccctatattgctagggagtttcagactaattgatgatttgtcttcatagcagagtttgactaattaatttgaattccagataccatacgtttcttatacagagtcaggctgcttaacctcttattttctaaacatcaaaa

SEQ ID NO: 10502 - DNA, 488 bp, Homo sapiens
ctgaggctggagaatagctagcacccaggaagcagaggttgcagtgagccgagatcgggccattgcactccagcctgggggacaaaagtgaaactccgtctcacaaaacaaaacaaaacaaaaaaagagtaaggactgtatgtctcacaccttggcacaccctcctggtgtctggtgtgatggaggggattattcctcatctctcctgagttcagtcttctgtaatgtagcatgctggggcctctggagcacttcactgcacactaacgaatgtgaggatggaaaaggaaaatcttatcttagtgaaactgtggaaatagtttagacctcgggctcccctaacaggcccctagacgatgctttgggaaccgtggtggtagaactctctctcccagactcactctgccctgacccctcttattggtgagaaacaggcatgtgtaactcttctttttcctttgaggaataaaagatatttgtacattttg

SEQ ID NO: 10503 - DNA, 1604 bp, Homo sapiens
tctcatgtacagcacatatgcgggagagttggcagaaaatttgtgaagagatgccgcaaaggaagggtctgttgacgggtgggattgggggttttgatgaagttgcttagtcctggttttgttttgaaaattactgcgttgcatttttgtgttaagtttttgaacccacgtgtgttttggtggagtatgagttggaagtcactgcaaactagcataaacaacaaagctcacagagtaggcacagatgtagagaacagagaccaaaatggggtgaggtggcagtaaatctaggatagggaaaaattaatgtgagggtgggaaataaactgtaattacctgaaatcaaatgtaagagtgcaataagtatgctttttattctaagctgtgaacggtttttttaagaatcattccttcctaatacatttgtgtatgttccatagctgattaaaaccagctatatcaacatataatgcctttttattcatgttaatgaccaacgtaagtggctagcctttatgtcttatttatcttcatgttatgttagtttacatacaggggtgtatgtctctgtgctgtccccttctcctgccttcattttaaaatgcatccatgggtcctccgtgtttcctttggccatgccacatatatagactcagtttggccttcatgatatcgcctgatttttgaggactgtatcacagtgatatgtatttgtggtaatctcatttgttggttgtacatctgatcctttcctcaacatggcaattgctgcctttcctaagataggatcatacaactgatcaggggattgaatttgatcattcatcaacatgtgtctctgaattttattcagtagttgtcattgctctttggtttagaccaagaaaaaggaaatccccccttttcatgtattccttggtttgaggacatgactcctgtaagggagaggaaagggagatgcttcctgtttgaactgcagtgaattcacggttcctgtttcaccactccaaaccttatggcgactcacacacacattcctcttttctgttactgccaaaggttcgggtttagtacacttcagttccactcaagcattgaaaaggttctcgtggagtctggggcgtgcccagtgaaaagatggggactttttaattgtccacagacctctctatacctgctttgcaaaaattacaatggagtaactatttttaaagcttatttttcaattcataaaaaagacatttattttcagtcaaatggatgatgtctccctcttttcccctattctcaatgtttgcttgaatcttttattattttttttaattctcccccatacccacttcctgatactttggttctctttcctgctcaggtcccttcatttgtactttggagtttttctcatgtaaatttgtataacagaaaatattgttcagtttggatagaaagcatggagaataaaaaaagatagctgaaattcagattgaagaaatttatttctgtgtaaagttatttaaaaactgtattatataaaaggcaaaaaaagttctatgtacttgatgtgaatatgcgaatactgctataataaagattgactgcatgga

SEQ ID NO: 10504 - DNA, 1891 bp, Homo sapiens
tctcatgtacagcacatatgcgggagagttggcagaaaatttgtgaagagatgccgcaaaggaagggtctgttgacgggtgggattgggggttttgatgaagttgcttagtcctggttttgttttgaaaattactgcgttgcatttttgtgttaagtttttgaacccacgtgtgttttggtggagtatgagttggaagtcactgcaaactagcataaacaacaaagctcacagagtaggcacagatgtagagaacagagaccaaaatggggtgaggtggcagtaaatctaggatagggaaaaattaatgtgagggtgggaaataaactgtaattacctgaaatcaaatgtaagagtgcaataagtatgctttttattctaagctgtgaacggtttttttaagaatcattccttcctaatacatttgtgtatgttccatagctgattaaaaccagctatatcaacatataatgcctttttattcatgttaatgaccaacgtaagtggctagcctttatgtcttatttatcttcatgttatgttagtttacatacaggggtgtatgtctctgtgctgtccccttctcctgccttcattttaaaatgcatccatgggtcctccgtgtttcctttggccatgccacatatatagactcagtttggccttcatgatatcgcctgatttttgaggactgtatcacagtgatatgtatttgtggtaatctcatttgttggttgtacatctgatcctttcctcaacatggcaattgctgcctttcctaagataggatcatacaactgatcaggggattgaatttgatcattcatcaacatgtgtctctgaattttattcagtagttgtcattgctctttggtttagaccaagaaaaaggaaatccccccttttcatgtattccttggtttgaggacatgactcctgtaagggagaggaaagggagatgcttcctgtttgaactgcagtgaattcacggttcctgtttcaccactccaaaccttatggcgactcacacacacattcctcttttctgttactgccaaaggttcgggtttagtacacttcagttccactcaagcattgaaaaggttctcgtggagtctggggcgtgcccagtgaaaagatggggactttttaattgtccacagacctctctatacctgctttgcaaaaattacaatggagtaactatttttaaagcttatttttcaattcataaaaaagacatttattttcagtcaaatggatgatgtctccctcttttcccctattctcaatgtttgcttgaatcttttattattttttttaattctcccccatacccacttcctgatactttggttctctttcctgctcaggtcccttcatttgtactttggagtttttctcatgtaaatttgtataacagaaaatattgttcagtttggatagaaagcatggagaataaaaaaagatagctgaaattcagattgaagaaatttatttctgtgtaaagttatttaaaaactgtattatataaaaggcaaaaaaagttctatgtacttgatgtgaatatgcgaatactgctataataaagattgactgcatggaaaaaaaaaaaaaaaaaaaaaaaaacaattttgggaaagaaggacaaaaaaaggtaataaaacatagtatggcagagaggacaccaaaaagaataaggaagaacaagtgccaaaaagagaaaaacaaaagaaacacccagagaaaaaagaaaagaggatagagatatcacacaaaaaaaaaacccaccggaagaaacaacaagaatataaagaaaaaaaccaaagagaaacaaagagaaaaaacaagggacaaataaaaggaacaaaaaagaagcaaataaaattacg

SEQ ID NO: 10505 - DNA, 1624 bp, Homo sapiens
tctcatgtacagcacatatgcgggagagttggcagaaaatttgtgaagagatgccgcaaaggaagggtctgttgacgggtgggattgggggttttgatgaagttgcttagtcctggttttgttttgaaaattactgcgttgcatttttgtgttaagtttttgaacccacgtgtgttttggtggagtatgagttggaagtcactgcaaactagcataaacaacaaagctcacagagtaggcacagatgtagagaacagagaccaaaatggggtgaggtggcagtaaatctaggatagggaaaaattaatgtgagggtgggaaataaactgtaattacctgaaatcaaatgtaagagtgcaataagtatgctttttattctaagctgtgaacggtttttttaagaatcattccttcctaatacatttgtgtatgttccatagctgattaaaaccagctatatcaacatataatgcctttttattcatgttaatgaccaacgtaagtggctagcctttatgtcttatttatcttcatgttatgttagtttacatacaggggtgtatgtctctgtgctgtccccttctcctgccttcattttaaaatgcatccatgggtcctccgtgtttcctttggccatgccacatatatagactcagtttggccttcatgatatcgcctgatttttgaggactgtatcacagtgatatgtatttgtggtaatctcatttgttggttgtacatctgatcctttcctcaacatggcaattgctgcctttcctaagataggatcatacaactgatcaggggattgaatttgatcattcatcaacatgtgtctctgaattttattcagtagttgtcattgctctttggtttagaccaagaaaaaggaaatccccccttttcatgtattccttggtttgaggacatgactcctgtaagggagaggaaagggagatgcttcctgtttgaactgcagtgaattcacggttcctgtttcaccactccaaaccttatggcgactcacacacacattcctcttttctgttactgccaaaggttcgggtttagtacacttcagttccactcaagcattgaaaaggttctcgtggagtctggggcgtgcccagtgaaaagatggggactttttaattgtccacagacctctctatacctgctttgcaaaaattacaatggagtaactatttttaaagcttatttttcaattcataaaaaagacatttattttcagtcaaatggatgatgtctccctcttttcccctattctcaatgtttgcttgaatcttttattattttttttaattctcccccatacccacttcctgatactttggttctctttcctgctcaggtcccttcatttgtactttggagtttttctcatgtaaatttgtataacagaaaatattgttcagtttggatagaaagcatggagaataaaaaaagatagctgaaattcagattgaagaaatttatttctgtgtaaagttatttaaaaactgtattatataaaaggcaaaaaaagttctatgtacttgatgtgaatatgcgaatactgctataataaagattgactgcatggagaagtcttcaaaaaaactat

SEQ ID NO: 10506 - DNA, 116 bp, Homo sapiens
ctggtgcagtcataggggctgctttgctggagctcttcatgagtcaggcatgtccctccagtgcagatgctctggtatgagcttccagggtacctgagactgccctgtaagcagct

SEQ ID NO: 10507 - DNA, 432 bp, Homo sapiens
gagactccaatttgtgagagctggtgagtagactgagtacagcaaacccatagaggccggactgcctatggctttgagggcccagttcccatcccagtgagcccagtattcaggacatggagtcaaaagagaatgattctctagctttaagacttaatgggccttgcacagtggctcacatctgtaatcccagcactttgggaggccaaggcgggcggactgcttgagctcaggagtttgagaccagcctgggcaatatggtgaaaccccgtctctacaaaacatacaaaaattagctgggcatggtgatgcacatctgtggtctcagctactcgggaagctaaggaaggaggattgcttgagccctagaggcaaaggttgcagtaagccaagatcatgctgtggcactccagcctgggtgacaaaatggga

SEQ ID NO: 10508 - DNA, 501 bp, Homo sapiens
acagagtttcaccatgttggccaggctggttttgaacttctgacctcaggtgatctgcccaccttggcctcccaaagtgctgggattacaggtgtaaaccaccgcacccagccctttaccatatttttgaaagtactttatgtgtctctctcctcatcttccacaaaatttgagaccttcaaaggtagaaactgttttatttaaaatataagagttcctgacacagagaaggttcccgagtgattgaagtgctacaatgtactaatcatactctggtctatgagttcattcccagattagctgtggattacatgtgtttcaaatgtatagctaggaatcgaaaagtggtctgagcttcaaaaagtcttactatattttaatacttccatatgaatttgacttaattatgtaaggaaatagttatgtatatatatcttattttaacaatagggttcaaaggagcttgacttttttggaattggaaataaaagtaggttcttt

SEQ ID NO: 10509 - DNA, 324 bp, Homo sapiens
cacatcagttattctgaaattttcagtgttatgatggatgttgcagtaattattcttatatatgcacagaacccccagaggacatgactactgaaggctgtgctggcaggatcacaggtaaggatctagcaaattgtcccagcttcattgactgagctttcatccttgttgcactactttgagctgccattttgatcatataataatgatttagtagagctcttttttggttcaacctacctgttcttgtatcagaactgaaatgtttgattttataaatttgaatagtggcacaatatagagttcactattcctcaatatttt

SEQ ID NO: 10510 - DNA, 502 bp, Homo sapiens
aaagtggaaacaacccaaatgtccatcaactgatgaaatgatacacaaaatgtggtatgttcataaaatgaaatattaatcagtaataaaaagaaatgaggtgctgatacattctgccaatgtggatgaattttgaaaacatgttaaatgaagaagcctgttgggaaagaccacatattgtataattccatttatatgaaatgtccagagtaggcaaaactggggaaacaaaaagtagattagtggttgtctaggactcgggtgggggtaggtggtagaaatggagtgactgctcacaggtactgggtttctcttgggggtgatgaaaatattctaaaattctattgtgatggttgcacaactctgaatgtactaaagctaatttaattgtgatgttaaatggatgaattgtactgtacgtgtgtgaattacatctcaataaagtttaaaaaataggaaattataaaaataaagatttgaactaggtcagtattttttaaag

SEQ ID NO: 10511 - DNA, 265 bp, Homo sapiens
aaccatttatttttcttcacagtatgtgcctacaattaataagaccacatcactttagttgttctgtggttcagaattttctgtaagtcagattggccagaaccactgtggttttcctgtgctgtcattattcaccttggtaacaaatcaggctgtatccaagtatattagttttgtatttcggaagccagttttgtcaaggatttgacaaaaggaattgccttcgttacttcctatctcccagggaagccgaatcattgcttaa

SEQ ID NO: 10512 - DNA, 750 bp, Homo sapiens
tgctggtcctcgatgagctagtctcagtcaagaggaacccacccagctccttccttccagacacagcagcatccagggcagatgtgggttccagtcccggatacctctgacacatcggcctgggaccatgagcaagttttacctctccctgaatctcactctggccagtcgaacactgggagggtctgctgagaagctggacctggtccctattctggccagggagtgtgaacccatgtcccattggagggggacagtcaggaccaacacaacaggacaaagaagtggccctcaggaactgggtccacgagagacaggattattaaggggggattctgtgcaggcggaagcctgtggtccttctcaatttgatactggagatgatcaggaaagcctcagcttctcccagaatgaattgagaggaccttccttccactatagcgaccaagatctccacctaaggggcgctcactggaagtttgctgaaatcccaaatcagcatgctcctgatttcagaagctgccatccacctttgcacttcaacacaaaatccaccacatcctaggctccagccctggaacaccaaatgaagccacacaagttctgcacaccaagacctcttcaatggaaggaaaatgaccactgagtttggtccacccttttcccacctcccgtaccaaatcccaaatcatcaaaacaggcccaactctgcatcttacagccagggaaactggggaccaccaggccagg

SEQ ID NO: 10513 - DNA, 1299 bp, Homo sapiens
ggctgcgctgggagccgggcggtcgggcggcggcggcggcgggcggcgccccggtccgcggcgccgaggctcgcaccgggagctgcccatgggccgggcccggagttccggcgcgccgggagccggcagacatgccacagacgctgagtgcctccgacatggtcaccccaggcagcctcagcccaccccccaccgagcccacagatggcgaacaggctgggcagcccctcctggatggagcgccatcctcagcctccctggaaacactgatccagcacctggtgcccacagccgactactaccccgagaaagcctacatcttcaccttcctgctgagctctcgcctcttcatcgagccccgggagctcctggcccgggtctgccacctgtgcatcgagcagcagcagctggacaagccggtgctggacaaggcccgggtccggaagttcggccccaaactgctgcagctgttggccgagtggaccgagaccttcccaagggacttccaggaagagtcgactatcgggcaccttaaggacgtcgtgggccgcatcgccccctgtgacgaggcataccggaagaggatgcatcagctcctacaggctctgcaccagaagctggcggctctgcgccagggccagaaggtctggtgggtgccgacaagcccatctcctacaggaccaagccaccagcctccatccacagggagctccttggtgtctgcagcgacccctacacactggcccagcagctgacccacgtggaactggagcggctgcggcacatcgggcctgaggagtttgtccaggcctttgtgaacaaggaccctctggccagcacaaagccctgcttcagtgacaagaccagcaacctggaggcttatgtgaaatggttcaacaggctgtgctacctggtggcaactgagatctgcatgccagccaagaagaagcagagggcccaggtgattgagttcttcatcgacgtggcccgcgagtgcttcaacatcggcaacttcaactccctcatggccatcatctccggcatgaacatgagccctgtctccaggctgaagaagacctgggccaaagtgaggacggccaagtttttcatcctcgagcaccagatggacccaacggggaatttctgcaactacaggacagccctgcgcggggcggcccaccgctccctgacggcccacagcagccgagagaagattgtcattcctttcttcagcctgctcatcaaagacatctacttcctgaatgagggctgcgccaaccgccttcccaatggacacgt

SEQ ID NO: 10514 - DNA, 936 bp, Homo sapiens
acgcgcagtgaggctcacgtgcccacccggcgcccctcacgagcgcggtgcccctcgcttgcccgtaggcccgggtccggaagttcggccccaaactgctgcagctgttggccgagtggaccgagaccttcccaagggacttccaggaagagtcgactatcgggcaccttaaggacgtcgtgggccgcatcgccccctgtgacgaggcataccggaagaggatgcatcagctcctacaggctctgcaccagaagctggcggctctgcgccagggccagaaggtctggtgggtgccgacaagcccatctcctacaggaccaagccaccagcctccatccacagggagctccttggtgtctgcagcgacccctacacactggcccagcagctgacccacgtggaactggagcggctgcggcacatcgggcctgaggagtttgtccaggcctttgtgaacaaggaccctctggccagcacaaagccctgcttcagtgacaagaccagcaacctggaggcttatgtgaaatggttcaacaggctgtgctacctggtggcaactgagatctgcatgccagccaagaagaagcagagggcccaggtgattgagttcttcatcgacgtggcccgcgagtgcttcaacatcggcaacttcaactccctcatggccatcatctccggcatgaacatgagccctgtctccaggctgaagaagacctgggccaaagtgaggacggccaagtttttcatcctcgagcaccagatggacccaacggggaatttctgcaactacaggacagccctgcgcggggcggcccaccgctccctgacggcccacagcagccgagagaagattgtcattcctttcttcagcctgctcatcaaagacatctacttcctgaatgagggctgcgccaaccgccttcccaatggacacgt

SEQ ID NO: 10515 - DNA, 328 bp, Homo sapiens
aaaaaagatggtaaaaggtacatgaatcaccatggactgcactgggcaagccattttagtgctgcaaatacgcagatacattcctctcacatatgtacagtgttttctcctctacagagtgtgtcttcactcgagctccaccagtcccctgtgtccaggtgaggcaggcattgttgttctggtttcattgacccagacctgcacttggccatatggccagcaaaggtggggctggttccttctcctcagcctatgctcattctgtagaacacaaatgcctgttgtcctctgatatttcactaaagtcttctccatctgaatcttactc

SEQ ID NO: 10516 - DNA, 372 bp, Homo sapiens
gaaaagcagaatgagctatcacatttatacctgttggatgcctactattaaaaaatggattagtaaggatgtggaataattggaactattgtacaccgttggtgaagtaaaaaatggcatggctattatggaaaataatatagttgctcctcaaaaattaaaaacagaactcccacttgatctagcaatctcacttttggatatttatccaaaagaattgaaatcaggatcttgaagggatacctgcaatgccatgttcattgcaacaccattcacaagagccaagatgtggaaacatcctcagtgtccactgatggatgaggggataaagaaaatgtggtatatacatacaagagattactattaatattc

SEQ ID NO: 10517 - DNA, 447 bp, Homo sapiens
ttttttttcacaaataggactttttatttgccactattaaaagtctgaacttcagacagattcttggactagtggttcatatccatcagttcgttcaactttagcacctgtcttgtccccagtggcttttccaaaactattaccttcaccacgaagctccataagttttcccaattcaaactagggcttcctcagcatttttacttttctaacgaagacatcacagagaggataaatagattggcaagccttttctatgtcttttccaatactgtctggaatcaacttattgaccacctctttccagtcatttgtctgtacctctcaggtcatgatttccatcatcttcttccagatttggaggacctgttggtgctgagcataagaggtcttccgtacctgattgttgcattttttagtaaaaccaacacagaacagatgaagcaa

SEQ ID NO: 10518 - DNA, 305 bp, Homo sapiens
ttttttttctcagcttcatgtgagtctataattatttcaaaataaaaagttaaaaagaaaacaaatggaaaaaagttatcaaacatgatttgtatcatgtcaaatggatatagagactaacttcaaaggaacagtttggccagtaggggaacagtttgaatatcaatgtgaataataattcaaatgaactgaaaaacatcaaatatatttaaatttatgagttcctaaaaataccaataaatgtagtcttcatatctggaagatgctaggaagcaatttgtttacaaattgcttctattgtttgg

SEQ ID NO: 10519 - DNA, 1657 bp, Homo sapiens
agggacccacgtgggagcctgggagcgggtggtcgtagctcggtagtccagttgtgggtaatcggggctgtttgttcctgtccgagagagctcggcggagacggctgtcgagtacccttcacctcggtgttgggagcctgggagcgaactgcggcgcgggttaccgctcccggggacgcagcaaggggcatcgagtccctggcgggagctgcgccatggcattgctctcgaccgtccggggcgcgacctggggtcgcctcgtcacccgtcatttctcccatgcagcgcggcatggggagcggcctggtggggaggagctaagccgcttgctgctggatgacctggtgccgacctctcggctggagcttctgtttggcatgaccccgtgtctcctggctctgcaggccgcccgccgctctgtggcccggctcctgctccaggcgggtaaagctgggctgcaggggaagcgggccgagctgctccggatggccgaggcgcgggacattccagttctgcggcccagacggcagaaactggacacaatgtgccgctaccaggtccaccagggtgtctgcatggagctgcccgctcactccagtagtcagcaagtccagcgcgggggctatggaggtgatggacgtgttctccactgatgacctcaccggatttttacagaccaaagcccagcagggctggctcgtggccggcacggtgggctgcccaagcacagaggatccccagtcctccgagatccccatcatgagttgcttggagttcctctgggaacggcctactctccttgtgctggggaatgagggctcaggtctatcccaggaggtgcaggcctcctgccagcttctcctcaccatcctgccccggcgccagctgcctcctggacttgagtccttgaacgtctctgtggctgcaggaattcttcttcactccatttgcagccagaggaagggtttccccacagagggggagagaaggcagcttctccaagacccccaagaaccctcagccaggtctgaagggctcagcatggctcagcacccagggctgtcttcaggcccagagaaagagaggcaaaatgagggctgacgtggactgtccacagtgttcatgtgctggagtcagggacggccgcacctgcctccgccggctccagtgtgcggggagcctctgcctgagtgtgcaccaggcccatgtttattgaccacagtctgggggggggggaaggggactgcggtggacaccagaggaagctgtttcctgttgtgatgttggacctgtagtaggacatggtgatttgttaatttccatgggaagccatgatggcctagcatggagggaatctgttcccaggccctgcctggaagttgagggaaagtttagacatctgcagagaggcaggcagcccagcccaggggacccgttcctcttgaaccagtcattgcctgtggcaaatgtgtgtatgagaatgtggggggtggagggcggggccctgatgtggagtagacagtgcgcacctcaggcccacacacggccccgccctggggccttgagcgcaggcctcatctttctgtgccgcgggactctgcacctacctcacagggttgttgtgaggctcaaataaaacatcactcagcacgtggga

SEQ ID NO: 10520 - DNA, 1833 bp, Homo sapiens
agggacccacgtgggagcctgggagcgggtggtcgtagctcggtagtccagttgtgggtaatcggggctgtttgttcctgtccgagagagctcggcggagacggctgtcgagtacccttcacctcggtgttgggagcctgggagcgaactgcggcgcgggttaccgctcccggggacgcagcaaggggcatcgagtccctggcgggagctgcgccatggcattgctctcgaccgtccggggcgcgacctggggtcgcctcgtcacccgtcatttctcccatgcagcgcggcatggggagcggcctggtggggaggagctaagccgcttgctgctggatgacctggtgccgacctctcggctggagcttctgtttggcatgaccccgtgtctcctggctctgcaggccgcccgccgctctgtggcccggctcctgctccaggcgggtaaagctgggctgcaggggaagcgggccgagctgctccggatggccgaggcgcgggacattccagttctgcggcccagacggcagaaactggacacaatgtgccgctaccaggtccaccagggtgtctgcatggaggtgagcccgctgcggccccggccttggagagaggccggggaggcgagcccaggcgacgacccccagcagttgtggctcgtcctcgatgggatccaggatccccggaattttggggctgtgctgcgttccgcacacttcctcggagtggataaggtcatcaccagccggagaaacagctgcccgctcactccagtagtcagcaagtccagcgcgggggctatggaggtgatggacgtgttctccactgatgacctcaccggatttttacagaccaaagcccagcagggctggctcgtggccggcacggtgggctgcccaagcacagaggatccccagtcctccgagatccccatcatgagttgcttggagttcctctgggaacggcctactctccttgtgctggggaatgagggctcaggtctatcccaggaggtgcaggcctcctgccagcttctcctcaccatcctgccccggcgccagctgcctcctggacttgagtccttgaacgtctctgtggctgcaggaattcttcttcactccatttgcagccagaggaagggtttccccacagagggggagagaaggcagcttctccaagacccccaagaaccctcagccaggtctgaagggctcagcatggctcagcacccagggctgtcttcaggcccagagaaagagaggcaaaatgagggctgacgtggactgtccacagtgttcatgtgctggagtcagggacggccgcacctgcctccgccggctccagtgtgcggggagcctctgcctgagtgtgcaccaggcccatgtttattgaccacagtctgggggggggggaaggggactgcggtggacaccagaggaagctgtttcctgttgtgatgttggacctgtagtaggacatggtgatttgttaatttccatgggaagccatgatggcctagcatggagggaatctgttcccaggccctgcctggaagttgagggaaagtttagacatctgcagagaggcaggcagcccagcccaggggacccgttcctcttgaaccagtcattgcctgtggcaaatgtgtgtatgagaatgtggggggtggagggcggggccctgatgtggagtagacagtgcgcacctcaggcccacacacggccccgccctggggccttgagcgcaggcctcatctttctgtgccgcgggactctgcacctacctcacagggttgttgtgaggctcaaataaaacatcactcagcacgtggga

SEQ ID NO: 10521 - DNA, 544 bp, Homo sapiens
gcgtgagagatcatggagctaggaagtagcctagcagggcttcacccaggctctcaccagcacaccactctcctggtgccccacagacgtctgcacctgcagggttgtcttggggttggttaagtgatgtcaagctgtggagcactgctcagaggcatacagtcggcactacttaaatgctagactctatcatgacttgacgactgtacttcgtcacacttgttgcctgttaagtccaagtttcatgaccgtctccctcctccccacactctaactgctctatttccaccccaactccctcgaaaggcaaatggtaacgaagtgcttccaggtagaagccggattgatttcatgtaattatccctgacaaaattaaatattacttgcaattagtcttgggcaatttctctgctgagacacagcgaggcagtggggtgaaaaagggctgagttggcccagcccctgctgggctgagggctgagtctgttggcagctgtgtgtgctctgcccgagaatgccctgtcgccaggacttaaacccacag

SEQ ID NO: 10522 - DNA, 680 bp, Homo sapiens
gggggcaggatgattccttgttgctcttttctctcttccatataaactttcaatctgcctgttaggttccagctttcactggagttgggttaaaggggtacatcgacctaagagggattcgtacgtcatctccggtatcattttcctatccctgatcatggtgtatctcatttatttaggtattagtagaattactcatagatgctttatattttactaatattatgattggaatttgtaagttacattcttaagctgttgctagaaaacagaagtgcgtatctgttttgaagatttgtatgccatctcttgatgctgtaactagcaatcctgctaaattcttacgaatgcaaagacatttgtctgtcaattcctttaccttttctgtgtagaaagtcatatctaggagtggatggtttgcccccttgtgtaaactgtcggtacgtttctggagccactgttccagcgctttgttccagatgagtttcctgagtaagcctggcctttactttcctgtgctgcacctggcaggttttgtcacgagggctctttgccgtcttcagtgagttaaggcgctttccttttttctgctctctggaagagctcttgtgaggtctgatcctcactgccttcaaggcttggaggctcacagttcaggttccaagtactgatttttcttc

SEQ ID NO: 10523 - DNA, 451 bp, Homo sapiens
agggccagaacctcagctttatgagctcgggaggtggctgtggttgagctgaggtggaagagtcgcctgtgggaagtacatggccttctttcctgcaggtcccacggctgctcagctgcagctggaggctggacgtgagtcactcccacaggcaggggtgtttttccctttatagccacagagcaggcccaggaagcaatgaaggtatgggcacggccgccccaggacaacggcatttgtgaggagaggggaaaatgcatttcagcagctgatggagaagtaagataggaagggaaagccagtgtttctgagagagagagagtgggtccagaaagctggacatcagagcagaatcttctcttacgataaaacagaagttcagcggtttcctcatgctagttctgtgttctaggtaccaaaaataaacttattttcgtaatatagagtgaaa

SEQ ID NO: 10524 - DNA, 1986 bp, Homo sapiens
tacaaagtgacatctggtgctccctcagaaagaatgtggccccagaggcatgccagtggctttagactctctgggaggacatgtttgagagcaacagccccttccccatcttttcctttcttctcagcagttataaatctctctgcctgcagtaagtagagtgagtggctggtgaggaggtttgttgatgacactgacaatatctggtgactccctccagatgtgcactcagcagtgagctgggcagaggcgtgggaaggacgttggctgggagcagacggcctctgcaaatgaatctctagtttcctgcaacctgggagtgtccccatgagttttactttcctactttatgaagtgaacctgctttctttgggatttcatgtactcctaatgctttttctctccaggtatttctttcctgctacatattaggactcccaaggcaagagtgcacctttatttagacctgggagtaaagggaaagagttgcctgtctttcgtgtgttttcagctttggctctgtgggatcagttatgcctcattcctgaaaagggcctttttatccccccagaatgcttttgctttgccaataccaccttcctcagcctgccttttggaaaggttgagaagctaaaaagtcaggtaagagaaggcagagatggacttcagaacctgatttttaaattttaaggcaaggctggctgccactggtgagagtgatgcagcagcctagcgtgttcccagcagaggtctagtctttgccctaagaagtcaccgcgcttatgaggttgctatcacagtgcatgtggtaggttagatttgagaaatggttaggattgttctgttggataagtgcagacacctgcccagggaagcagctctttttttgtaagagttttcttggttactgaaatcaaatgggggaccagtttgttataggagacatctgtggccagcaaatctgaacagcttcctagagggaaagtacctcttttaaactaagttattatagacagtgaatgaatcctacccttaaaagagatgacggcagggtaagtgcaaagtaaaacctccttgctctagtctcttgggagagtattgtaatgaaagcagcgtttacttcgttgttgttgcattggggtgaaaaatctgagatgctggaatgatggcaatgtttgccttctctccttcccttcctgacagccagtgtgggccaggctccactctccatcttcacaccctgcccttgctccagtatttccattctgtttttctcctctgtctctttctgtctttctctcaaactccatcctgcttccacccctgcccgcttttcttctcctttcctggaagtaatcattaaacaaaagaaaaagttgaatgttctttggtgagtttccttcttctctgccttttccttctttagccagttcccctcaacccctgtgcactccataggaaggacaaacttacctgtctgcttccttcccatgtgcttctccccaaattttcatatagatatatacgtacactccttttggaataaacgaagaggtacattatatttgacacaaacttgggagtgttaagaggtcataagtgtttacctatcagataaccatctgtggctctgtgttggattttttttataccattaggaaaatgggaatttttttataggcctgccatacttctactttgccaaatagcactttattatcaagatacacccatggctcatttcagactcactgaactttttttatatgaatgcacagtcgtcatattttgggcagtctgtgagttcttggtaactcatccccttactacaaaagcactaagtgaacaatacaaaagtataaaagcacaaatttgaacttacatagtttagtttaagtatgtttcactagaaaatcaaatatttagatttctcacattgaaaatgcttaggattgaggtttagctgcttcctttaaaaaaaaaaaa

SEQ ID NO: 10525 - DNA, 240 bp, Homo sapiens
ttctttttttctgcaaagctgctttataggtggtgctgcatttttccaaaagtaggtacagtaatccacacttaacccactggatatatgtttcaagaccctcagtggatgtctgaaaccacagatagcaccaaactctatatatactatgttttttctatacatacatacatacatacctataataaagtttaatttataaattaggcacagtaagagattaacaaaaactagtaatag

SEQ ID NO: 10526 - DNA, 2902 bp, Homo sapiens
aggtatagacctgttgccagcccaaaagcacctgtaggaggtagctggaagcccctgttgaaggtcctacccagtgaggaaaacatgattggggacccacttaagaaagcagtctagccatatttttgcaggacagctctgctattcagaggtaccacttccacccccagtttatttggattctccaaagccagaaggctggaacagctaactcacacaaacagcaaaaatggcagctcactcctccctctaggaactgtatcccaaagaggtttcaaaactccatcaaccaaagagcgctggtggtggtagctggagaccctcattgggaagtactttccagtgagaaggaatgaaacgggggacctgctttaacaggcagtctggccatgtctttttagagcacctgtactgtgctaggagatcctttccgccccccggtcagcttgggctcttcaaagcctgaaggctggaatggctaagttgctcaagcagcaaagatggtggcccactcctctttctggtagctccatcccagggaggtgcagtgctgctaccaatggttggctggaatctaagccagtaggtcttaccacgtgaggcattgttgaagtgggtcctacagaccatcactatcagccccctggattctgcctctttcctatgggtatgttcaggggtgtaacctgctttgctcgagttgcagctactttttctgggaagcctggaaagccagtatctaaggctcttgaatctgcgcaggcctaagtggcttatctgctgagactccatgtagctctgtgtgttaaactgaaggccttggtgaagtgggttcatgagggtatctcctcacctgaaggttgcagagatctgtgggagaatcatgggtttctagggtcacacatgcactcactgctttactgggtggggaggttcccttggctccatgttgttcccaggtggcccattgtcctgccttgctttactccattctccatagattgtttctttgattattcccaatgcaagtacctggatgtttcagttgcaggtgctgtatttatgtataccttgcattcctgtctatgagaactgcacagtctagctgcttctagtcagcaatctcgatcacttttctctaaagggaacctacttttttatattaaaaggattcaatatttttcaaaagcaaatttcaatgtaatttaactcttacatttgatgctgtgtcttcatttctagaatttatgtgaaagaacatggtcagtggttgcaccagagttgtgagaggttcttctatattagatggacagatttatatacttttccatggaggattaagtaaactgaaacctaagacacacgaagaaattctaagtggaaaggccacttattagttagtttacagcagtatcgtaagtgacaggatgataggagtgtggtaagtgatcaggataataatctgcttagtaagagaaacaatttgaattttagaaggaaattgccttaccatttgcaaattaaggtaattaaaatacagtgaatttcaaaatgcctttttaatgacaatgtgtgaacttaatttgttttaataaaccaaaattgttgttattgtgttaaggctattttacattgaatgtgtatcttgccactgatgttaacttatcccatcttacccaaggttgtaggtaacaatatactattgggtgacagtggactaacatctctagtgatccctttgtcagtggtctttaacttaaaataatttagagaatatggtttctacaacttacatttttgttttcttgtaactacagattattatgatggttgtaatgaagattatgagtataattggagctatatgtttctgaattctgaacaactatttataaaattttatcctacttttttctgttgaacatatgacttctctggtctgctaaacacatacagacctttagttttggtttacatggatttaaatatatagatatatcactgtaaaataaacttcaggtgtaacagatttatagagaaagtaatcatatttgtttatggttgtgtacctactttgagaagaaaagaaaaatattagaatgaacagataattttacaagtgttgatcacttaccagcaaaccagaaacttcagagattttgaaagcaaatctattttctctgctgtgtattaaattcatttatctaaaatgttattgctcctggcttagaatcatcttgtgcaaattctctttttttgttgtttgtctgtttgcctgttgctcaccatagacataattttcttttcataaaacattctttgtataatcacctcagagattatgaaagtgactttgataaaatttaatggtgttcacaaaataattttcacgtgagtaatttcacagtgcgtgtattgtatgttatttagtgtattttatattttgtttcaattagagaatgctattgaatccagtttttgtttagttactgttcattttactttataaaattgacataattgagtttattaaatttattgggccaatttaagtaaacagttgaacgtttcataagtcatgaggtctttttggcatatacatgaagtaaacaaagacaatactagctatgtaatagaagctacataattagaagtaaatattctttttgaaattggcctgtggtctcaggtgaaaaatggaaaatatctatagtaaaaaaaatgacattaattctgcatatgaagagagcataattgtacccatgccacacaattgacttcacaattggaaacaaggtggaaggaggtgggacattttaggcaaaactaaggtggaaaaccttgttaaatttttcaggttatgtttctacctttaaacatctactgggggaggcagaggcca

SEQ ID NO: 10527 - DNA, 2651 bp, Homo sapiens
aggtatagacctgttgccagcccaaaagcacctgtaggaggtagctggaagcccctgttgaaggtcctacccagtgaggaaaacatgattggggacccacttaagaaagcagtctagccatatttttgcaggacagctctgctattcagaggtaccacttccacccccagtttatttggattctccaaagccagaaggctggaacagctaactcacacaaacagcaaaaatggcagctcactcctccctctaggaactgtatcccaaagaggtttcaaaactccatcaaccaaagagcgctggtggtggtagctggagaccctcattgggaagtactttccagtgagaaggaatgaaacgggggacctgctttaacaggcagtctggccatgtctttttagagcacctgtactgtgctaggagatcctttccgccccccggtcagcttgggctcttcaaagcctgaaggctggaatggctaagttgctcaagcagcaaagatggtggcccactcctctttctggtagctccatcccagggaggtgcagtgctgctaccaatggttggctggaatctaagccagtaggtcttaccacgtgaggcattgttgaagtgggtcctacagaccatcactatcagccccctggattctgcctctttcctatgggtatgttcaggggtgtaacctgctttgctcgagttgcagctactttttctgggaagcctggaaagccagtatctaaggctcttgaatctgcgcaggcctaagtggcttatctgctgagactccatgtagctctgtgtgttaaactgaaggccttggtgaagtgggttcatgagggtatctcctcacctgaaggttgcagagatctgtgggagaatcatgggtttctagggtcacacatgcactcactgctttactgggtggggaggttcccttggctccatgttgttcccaggtggcccattgtcctgccttgctttactccattctccatagattgtttctttgattattcccaatgcaagtacctggatgtttcagttgcaggtgctgtatttatgtataccttgcattcctgtctatgagaactgcacagtctagctgcttctagtcagcaatctcgatcacttttctctaaagggaacctacttttttatattaaaaggattcaatatttttcaaaagcaaatttcaatgtaatttaactcttacatttgatgctgtgtcttcatttctagaatttatgtgaaagaacatggtcagtggttgcaccagagttgtgagaggttcttctatattagatggacagatttatatacttttccatggaggattaagtaaactgaaacctaagacacacgaagaaattctaagtggaaaggccacttattagttagtttacagcagtatcgtaagtgacaggatgataggagtgtggtaagtgatcaggataataatctgcttagtaagagaaacaatttgaattttagaaggaaattgccttaccatttgcaaattaaggtaattaaaatacagtgaatttcaaaatgcctttttaatgacaatgtgtgaacttaatttgttttaataaaccaaaattgttgttattgtgttaaggctattttacattgaatgtgtatcttgccactgatgttaacttatcccatcttacccaaggttgtaggtaacaatatactattgggtgacagtggactaacatctctagtgatccctttgtcagtggtctttaacttaaaataatttagagaatatggtttctacaacttacatttttgttttcttgtaactacagattattatgatggttgtaatgaagattatgagtataattggagctatatgtttctgaattctgaacaactatttataaaattttatcctacttttttctgttgaacatatgacttctctggtctgctaaacacatacagacctttagttttggtttacatggatttaaatatatagatatatcactgtaaaataaacttcaggtgtaacagatttatagagaaagtaatcatatttgtttatggttgtgtacctactttgagaagaaaagaaaaatattagaatgaacagataattttacaagtgttgatcacttaccagcaaaccagaaacttcagagattttgaaagcaaatctattttctctgctgtgtattaaattcatttatctaaaatgttattgctcctggcttagaatcatcttgtgcaaattctctttttttgttgtttgtctgtttgcctgttgctcaccatagacataattttcttttcataaaacattctttgtataatcacctcagagattatgaaagtgactttgataaaatttaatggtgttcacaaaataattttcacgtgagtaatttcacagtgcgtgtattgtatgtattaggtatatattgttgcattagagaatgtatgatcagttgttagtagtcctttactcataatggctatgggtttaaattttgggcattagtaccggccgtcaaaaccagaggctgggataagagaaagagatgttgttagccataaaatcttgatgaaaaaagggaaaacgggcacccattgagggaagaatagggaaggaggtgaagggacacaattgcggatga

SEQ ID NO: 10528 - DNA, 279 bp, Homo sapiens
ctaatgccacactgaggaggactattagaaccttatatttcctggaatctgaatcaaatgatgaaaggcatggccccatgtcccattcccccacaggaatagacgactgcagaaattacccttccaaaaaaagatgtctcttaaagaaagcagcaggcagctagaggaggaggagtaagagctgaggtaccccagaggcagcccccctgagtctagcacagactggcaccaaaggtgttcaatagcaatttgctggatgggtgaatatgtgggtgaatg

SEQ ID NO: 10529 - DNA, 358 bp, Homo sapiens
gctacagctcgaatgaatcgtttattcttctgcatcacttccagcctcgtccacagcctagccacacagcttcccaaccaacaacaagcaacacagccgtgggtccagattatagcccagtggggagggggaataggaaggtctcgaaagaacctgtgaagaccctgcacttggcatgttgcaaataggttgtgcttgcacccctaggccttgagttgcccacgttgggcaactggagcaggtggagctcctggccagttagctctcaccatgaacagcacatccatttacccaagagcaccacacaaatatcatcattttctatatgtgctatgtcctgaaacaaaaaggggggatg

SEQ ID NO: 10530 - DNA, 521 bp, Homo sapiens
cttttttttttttttttgagatggagtctcgctctgttgcccaggctggagtgcagtggcgcgatctcggctcactgcaagctccgcctcccgggttcacagcactatcctgcctcagcctccaaattagctgggactacaggcacccaccaccacgccccgctaatctttttgtatttttagtagagccaaggtttcaccgtgtgttagccaggactgtctcgatctcctgacctcctgacctcgtgatctgcccgcctcagccttccaaagtgctgggattacaggcacgagccactgtgcccggccggaggctagttaaacttaatcattaggttgagaaatttgaaaggctccaacaaccccaattttacatttgtatacagaaactcacaaaattactaagttgagtggaacctggaaggaacaataccgtgatgaagagaagggaaacgcctgggactgaagaacacatttcctactttctgctcatgaatacagacaataaagaattaatttcc

SEQ ID NO: 10531 - DNA, 549 bp, Homo sapiens
gtcacagagacttagtgaagtgcacacattgctcacctgggtgaactgaggtccagcgggggaaggcttcctcctgttgtaatcactaaccccaactctgtctcccttgcccgattcattcattcgttaattaattcatccaacatcctgtccccaagaagctcagtctggggacatactgatccagttaaatgcgagtgcttcctagttatacatggcgactgctgagaagggactccagagtccaggcacctacctcccaggggctcaccgttcactcctctagcctcatttagagctcgcattaagagcacgggatctggatccacactgtttggattcaaatcacaacttcaccacttagcagctgtgtgttctgggaaaatgacccaccttctctgtgcctccattttctcacctgtaaaacgggctcccaggctggtgggagggtttcaggtgtaagacatggagagtcctttagcgaacatgtagactggcaataaactcaataaatggtgactgttataattaatcctcggaaccatccta

SEQ ID NO: 10532 - DNA, 191 bp, Homo sapiens
gttgacccaaggctggagggcctctgttttaatgtgagctccttagctgtccccttgaattcccagaaagcgtggcagggcctgcctagttctgggtgctcatcccgaccccgcctgagggttttcagtgtgtgaattactgcagtaggaaatatggagaagtgattctcctccctttactacggtattgg

SEQ ID NO: 10533 - DNA, 466 bp, Homo sapiens
taagtgaacatctcggaatcataaaagtgaagcagttgtttacttggacagcagattacaggaaggagaaactaagtgtggtcaactgactagaaacagcaagacacgatagatcacaatggaaatgaaaaacaggagaaaactaaataaaccaatgtttattgcacatcaaattaccatactaggcacacgtgtccatattaaatggaagaatacgaacataacctaagacaaatgaagcaagagttaggaagactagagactaaaataaaatgaagcttgagaaaaggactgggaacacaatttaaaaactagcaaagggtaagtatttaaaggtgaatttggtgcaaggtgatctgcctgctagactgtggcatgttaatgaatgctagagagcaggctgaactgccaggatcctgttttacgtctgtaaactacaaaaaaaaaaaaaaaagcccccagaaat

SEQ ID NO: 10534 - DNA, 270 bp, Homo sapiens
taaatcccatatattaatcctaagactataaaacaggaaatacaattattttcaaaaatttatataccaactttcatttaaaatgtctatattcataaccacagaaaataggcatcaatcatccaataatatagatagaaagaaaaaagcaaaatagctagaggcttaatccaggtatcatagtaaatagataacttattttctaggtgaccaatttagaagcaatctactcaaatacatcctgaggtttgaaaaatgttattaaatctt

SEQ ID NO: 10535 - DNA, 442 bp, Homo sapiens
ttctcacccacagatgcgggcggcagcacatcacaagtaagcagcattcatcactctgcacaataaccactgtgacccagcctccctgcacaattgacacagttattgtggctatgacagcaagatcccaactaggaacacaattagcgtctattgcaagaaagaatgctctacattgttgtttagcattgaagcttttcagaaaggggaggaaaattattgtaaaggcaggctaacaaaacaataatgctccactagtgcccaaggttacagtggaggaggaggaggacaggagtggaagctatcacatcctagttgttcttcagtacatagctaaagaattgtaacaggaagcacttttataaagaataaaacaaacaaaaagaacttgtaaaaaagagcaattttatctttttcaaccaattatctcagtggatttttg

SEQ ID NO: 10536 - DNA, 308 bp, Homo sapiens
ggggcagtgtcttatatatgatacacattttatcatatcatcttctatagataatataatgattaacacaaaacactcttctacacacacagaatactcttgtatcactttgggttttttttccttcgtgtgtgtgtgtgtgtgtgtgtgtgtgtgtgtgtgtgtgtgttatgagacaaggtctggctctgtcacccaggctgcagtgcagtgttgcagtcttggcccatgccccaccgcagcctctggaatagctgtctgcaggccaggcacggtagctcaggcatgtcgtctcagcactcttggag

SEQ ID NO: 10537 - DNA, 3425 bp, Homo sapiens
agcggagcgcgagccgagccgcggccagctccggcgggcagggggggcgctggagcgcagcgcagcgcagccccatcagtccgcaaagcggaccgagctggaagtcgagcgctgccgcgggaggcgggcgatgggggcaggtgccaccggccgcgccatggacgggccgcgcctgctgctgttgctgcttctgggggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcggaggcttgtcagagctgggaggggttttcgaagctcagcccacccccctcattttggatataggtcagtgaggcccagggagaggccatgattcgcccaaagccagacagcaacggggaggccaagtgcaggctggcaccgccttctctaaatgaggggcctcaggtttgcctgagggcgaggggagggtggcaggtgaccttctgggaaatggcttgaagccaagtcagctttgccttccacgctgtctccagacccccaccccttccccactgcctgcccacccgtggagatgggatgcttgcctagggcctggtccatgatggagtcaggtttggggttcgtggaaagggtgctgcttccctctgcctgtccctctcaggcatgcctgtgtgacatcagtggcatggctccagtctgctgccctccatcccgacatggacccggagctaacactggcccctagaatcagcctaggggtcagggaccaaggacccctcaccttgcaacacacagacacacgcacacacacacacaggaggagaaatctcacttttctccatgagttttttctcttgggctgagactggatactgcccggggcagctgccagagaagcatcggagggaattgaggtctgctcggccgtcttcactcgcccccgggtttggcgggccaaggactgccgaccgaggctggagctggcgtctgtcttcaagggcttacacgtggaggaatgctcccccatcctccccttccctgcaaacatggggttggctgggcccagaaggttgtgatgaagaaaagcgggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggagtgagtgtggctcccctctatttagcatgacaagccccaggcaggctgtgcgctgacaaccaccgctccccagcccagggttcccccagccctgtggaagggactaggagcactgtagtaaatggcaattctttgacctcaacctgtgatgaggggaggaaactcacctgctggcccctcacctgggcacctggggagtgggacagagtctgggtgtatttattttcctccccagcaggtggggagggggtttgggggcttgcaagtatgttttagcatgtgtttggttctggggcccctttttactccccttgagctgagatggaacccttttggcccccgagctgggggccatgagctccagacccccagcaaccctcctatcacctcccctccttgcctcctgtgtaatcatttcttgggccctcctgaaacttacacacaaaacgttaagtgatgaacattaaatagcaaagaaagaaaaatagtacaaagag

SEQ ID NO: 10538 - DNA, 3703 bp, Homo sapiens
gagtctggggctgcgcgccgctccccacctagctgcgcgacccgagcgcagcgcccaccgcgctccgtgggctcccgcgcctcgaagggtcgggatccggtctgagcctctcctggctctcggtgcaagccgctgggcacctaacgagacgggggcgcccggacgcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcggaggcttgtcagagctgggaggggttttcgaagctcagcccacccccctcattttggatataggtcagtgaggcccagggagaggccatgattcgcccaaagccagacagcaacggggaggccaagtgcaggctggcaccgccttctctaaatgaggggcctcaggtttgcctgagggcgaggggagggtggcaggtgaccttctgggaaatggcttgaagccaagtcagctttgccttccacgctgtctccagacccccaccccttccccactgcctgcccacccgtggagatgggatgcttgcctagggcctggtccatgatggagtcaggtttggggttcgtggaaagggtgctgcttccctctgcctgtccctctcaggcatgcctgtgtgacatcagtggcatggctccagtctgctgccctccatcccgacatggacccggagctaacactggcccctagaatcagcctaggggtcagggaccaaggacccctcaccttgcaacacacagacacacgcacacacacacacaggaggagaaatctcacttttctccatgagttttttctcttgggctgagactggatactgcccggggcagctgccagagaagcatcggagggaattgaggtctgctcggccgtcttcactcgcccccgggtttggcgggccaaggactgccgaccgaggctggagctggcgtctgtcttcaagggcttacacgtggaggaatgctcccccatcctccccttccctgcaaacatggggttggctgggcccagaaggttgtgatgaagaaaagcgggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggagtgagtgtggctcccctctatttagcatgacaagccccaggcaggctgtgcgctgacaaccaccgctccccagcccagggttcccccagccctgtggaagggactaggagcactgtagtaaatggcaattctttgacctcaacctgtgatgaggggaggaaactcacctgctggcccctcacctgggcacctggggagtgggacagagtctgggtgtatttattttcctccccagcaggtggggagggggtttgggggcttgcaagtatgttttagcatgtgtttggttctggggcccctttttactccccttgagctgagatggaacccttttggcccccgagctgggggccatgagctccagacccccagcaaccctcctatcacctcccctccttgcctcctgtgtaatcatttcttgggccctcctgaaacttacacacaaaacgttaagtgatgaacattaaatagcaaagaaagaaaaatagtacaaagag

SEQ ID NO: 10539 - DNA, 3372 bp, Homo sapiens
agcggagcgcgagccgagccgcggccagctccggcgggcagggggggcgctggagcgcagcgcagcgcagccccatcagtccgcaaagcggaccgagctggaagtcgagcgctgccgcgggaggcgggcgatgggggcaggtgccaccggccgcgccatggacgggccgcgcctgctgctgttgctgcttctgggggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcggaggcttgtcagagctgggaggggttttcgaagctcagcccacccccctcattttggatataggtcagtgaggcccagggagaggccatgattcgcccaaagccagacagcaacggggaggccaagtgcaggctggcaccgccttctctaaatgaggggcctcaggtttgcctgagggcgaggggagggtggcaggtgaccttctgggaaatggcttgaagccaagtcagctttgccttccacgctgtctccagacccccaccccttccccactgcctgcccacccgtggagatgggatgcttgcctagggcctggtccatgatggagtcaggtttggggttcgtggaaagggtgctgcttccctctgcctgtccctctcaggcatgcctgtgtgacatcagtggcatggctccagtctgctgccctccatcccgacatggacccggagctaacactggcccctagaatcagcctaggggtcagggaccaaggacccctcaccttgcaacacacagacacacgcacacacacacacaggaggagaaatctcacttttctccatgagttttttctcttgggctgagactggatactgcccggggcagctgccagagaagcatcggagggaattgaggtctgctcggccgtcttcactcgcccccgggtttggcgggccaaggactgccgaccgaggctggagctggcgtctgtcttcaagggcttacacgtggaggaatgctcccccatcctccccttccctgcaaacatggggttggctgggcccagaaggttgtgatgaagaaaagcgggccagtgtgggaatgcggcaagaaggaattgacttcgactgtgacctgtggggatttctcccagctctagacaaccctgcaaaggactgttttttccctggcctgttctgttttgcctgaagttggagtgagtgtggctcccctctatttagcatgacaagccccaggcaggctgtgcgctgacaaccaccgctccccagcccagggttcccccagccctgtggaagggactaggagcactgtagtaaatggcaattctttgacctcaacctgtgatgaggggaggaaactcacctgctggcccctcacctgggcacctggggagtgggacagagtctgggtgtatttattttcctccccagcaggtggggagggggtttgggggcttgcaagtatgttttagcatgtgtttggttctggggcccctttttactccccttgagctgagatggaacccttttggcccccgagctgggggccatgagctccagacccccagcaaccctcctatcacctcccctccttgcctcctgtgtaatcatttcttgggccctcctgaaacttacacacaaaacgttaagtgatgaacattaaatagcaaagaaagaaaaatagtacaaagag

SEQ ID NO: 10540 - DNA, 3340 bp, Homo sapiens
  misc_feature (3263)..(3263): n is a, c, g, or t
agcggagcgcgagccgagccgcggccagctccggcgggcagggggggcgctggagcgcagcgcagcgcagccccatcagtccgcaaagcggaccgagctggaagtcgagcgctgccgcgggaggcgggcgatgggggcaggtgccaccggccgcgccatggacgggccgcgcctgctgctgttgctgcttctgggggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcggaggcttgtcagagctgggaggggttttcgaagctcagcccacccccctcattttggatataggtcagtgaggcccagggagaggccatgattcgcccaaagccagacagcaacggggaggccaagtgcaggctggcaccgccttctctaaatgaggggcctcaggtttgcctgagggcgaggggagggtggcaggtgaccttctgggaaatggcttgaagccaagtcagctttgccttccacgctgtctccagacccccaccccttccccactgcctgcccacccgtggagatgggatgcttgcctagggcctggtccatgatggagtcaggtttggggttcgtggaaagggtgctgcttccctctgcctgtccctctcaggcatgcctgtgtgacatcagtggcatggctccagtctgctgccctccatcccgacatggacccggagctaacactggcccctagaatcagcctaggggtcagggaccaaggacccctcaccttgcaacacacagacacacgcacacacacacacaggaggagaaatctcacttttctccatgagttttttctcttgggctgagactggatactgcccggggcagctgccagagaagcatcggagggaattgaggtctgctcggccgtcttcactcgcccccgggtttggcgggccaaggactgccgaccgaggctggagctggcgtctgtcttcaagggcttacacgtggaggaatgctcccccatcctccccttccctgcaaacatggggttggctgggcccagaaggttgtgatgaagaaaagcgggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggagtgagtgtggctcccctctatttagcatgacaagccccaggcaggctgtgcgctgacaaccaccgctccccagcccagggttcccccagccctgtggaagggactaggagcactgtagtaaatggcaattctttgacctcaacctgtgatgaggggaggaaactcacctgctggcccctcacctgggcacctggggagtgggacagagtctgggtgtatttattttcctccccagcaggtggggagggggtttgggggcaaggaataattatttaacttctggtcagaggtgaaaccacctgttagaacccatacatcggggatggaactacccnaggaaaatgaactggggagggttaaccgaatattactcacatgcatgtctttgggtccaaacagggccttttgaatt

SEQ ID NO: 10541 - DNA, 2523 bp, Homo sapiens
agcggagcgcgagccgagccgcggccagctccggcgggcagggggggcgctggagcgcagcgcagcgcagccccatcagtccgcaaagcggaccgagctggaagtcgagcgctgccgcgggaggcgggcgatgggggcaggtgccaccggccgcgccatggacgggccgcgcctgctgctgttgctgcttctgggggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcggaggcttgtcagagctgggaggggttttcgaagctcagcccacccccctcattttggatataggtcagtgaggcccagggagaggccatgattcgcccaaagccagacagcaacggggaggccaagtgcaggctggcaccgccttctctaaatgaggggcctcaggtttgcctgagggcgaggggagggtggcaggtgaccttctgggaaatggcttgaagccaagtcagctttgccttccacgctgtctccagacccccaccccttccccactgcctgcccacccgtggagatgggatgcttgcctagggcctggtccatgatggagtcaggtttggggttcgtggaaagggtgctgcttccctctgcctgtccctctcaggcatgcctgtgtgacatcagtggcatggctccagtctgctgccctccatcccgacatggacccggagctaacactggcccctagaatcagcctaggggtcagggaccaaggacccctcactttcttgggccctcctgaaacttacacacaaaacgttaagtgatgaacattaaatagcaaagaaagaaaaatagtacaaagag

SEQ ID NO: 10542 - DNA, 4477 bp, Homo sapiens
  misc_feature (1950)..(1950): n is a, c, g, or t
  misc_feature (1992)..(1992): n is a, c, g, or t
aggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggccgagctgcaggagaccttcggccnttttggcagcctgggccgcgtgctgctgccagagggcggaancactgccatcgtggagttcctggagcccctggaggcccgcaaggccttcaggcatctggcctattccaagttccatcatgtccccctctatctggagtgggctccagttggcgtcttctccagcgcagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggctggagtgcagtggcgtgatctgggctcacctccctggttcaagcgattgtcccgcctcagcctcccaaggctgggattacaggtatgcaccaccacgcccggctaattttgtatttttcatagagactgggtttcaccatgtagaccaggctggtctcgaattcctgacctcaagtgatccacctacctcggcctcccaaagtgtggggattacgggtgtgagccaccacgcctggctaattttttgtatttttggtagacggggtttcaccatgtgggccaggctggtcttgaactcccaacctcaagtgatccacccaccttgttctcccaaagtgctgagattacaggtgtgagccaccatgcccagcctgttcctaaccctttcaactggggggtctcaagtgggtgaggactccatggccacggcagcagaactgtctcttctgaaaaccagactccggggcccctgggtcagcacctctaggtcattccacagacttacacagtttaaagaaagagccagcgaacatggggtgatcctggggtgccactgggatcccaagccaggcccggaggtctgcctgtttcgtccccagaaacttgagctggcatcctccgctggtttgcactgggcacggggactggagagccaccaggccactgagcacagcatgctatcacttctcaggaagttgtgagggtgaggagaatagccgggcccactctgcagaggggaggaacaggcacaggctagaggcacgggctgatagagtgagtcctctccctcattcattcattcattcattcattcatccatcagacacctgctgggcatctgctgtgtgcgagacactgtgctgggtgccccagacacaagacagaaactcgggtcgctctgtgtgcctccacactggccttccctgctgcgtggacgcaggctctgtctcctaggctttaagccccatgcatcaggtggaagacaatttccagcagcctctgcccgcttgtttttcctcctctccttttcctgccgccttggtcttttttgtcttttgtgcagggccgtctctcgcagcgcccgtctgtgctccgcagcgtctaggaaaggattagtgtgagcagagcatgcaggctttggtgaacagagccgagcttggtttcaacatctaattcaatttgttctgccgagattgaaatatgaaatggttgccagtcaaacgttcaaaggacggggaagggagagtgagcgcatgctgaaatttaaattttaatgaaaatgactttaaccctttggtacaccttgcaaaatgtaacccatcctcccatcctgtgaaagcggcctctcgggttagagcttttccacccacttctcttccactgagcttcactaataatatgtaatcatttttttcagccgtcttaataataaaagattaatagaatgcttgca

SEQ ID NO: 10543 - DNA, 4177 bp, Homo sapiens
  misc_feature (1950)..(1950): n is a, c, g, or t
  misc_feature (1992)..(1992): n is a, c, g, or t
aggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggccgagctgcaggagaccttcggccnttttggcagcctgggccgcgtgctgctgccagagggcggaancactgccatcgtggagttcctggagcccctggaggcccgcaaggccttcaggcatctggcctattccaagttccatcatgtccccctctatctggagtgggctccagttggcgtcttctccagcgcagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggtgtgtggctccggggccctggggaccgggacagccgctccagcttctgcactcaccaccatgtgggctggggggcggggcggggagcggcaggcggccccaccctgcactggtccaaggtcggaggagacaggggatgaggaaggcctcaggccactgcccagcggcccaggcatcctgggtttcaccagtgacgcgttctagcagacactgactgcgcacctgctctgtagcagacacggaagagtccaagggagcagccacgttaggaagagagacttgggaacagctacacagggagctagaacccctgctccccctgtccccaccccaggagagtaaggggacgagggccagctctctggcatcaggctgcttggacatgaaaccccgtctccaagctcaagctgggagaccctggcccagtttccttatctccttgggcccagccttccccttgctagctagttcttacttcataaggttttagagagaaataaacgcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatcagca

SEQ ID NO: 10544 - DNA, 3615 bp, Homo sapiens
  misc_feature (1950)..(1950): n is a, c, g, or t
  misc_feature (1992)..(1992): n is a, c, g, or t
aggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggccgagctgcaggagaccttcggccnttttggcagcctgggccgcgtgctgctgccagagggcggaancactgccatcgtggagttcctggagcccctggaggcccgcaaggccttcaggcatctggcctattccaagttccatcatgtccccctctatctggagtgggctccagttggcgtcttctccagcgcagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagaggggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatcagca

SEQ ID NO: 10545 - DNA, 3544 bp, Homo sapiens
  misc_feature (1950)..(1950): n is a, c, g, or t
  misc_feature (1992)..(1992): n is a, c, g, or t
aggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggccgagctgcaggagaccttcggccnttttggcagcctgggccgcgtgctgctgccagagggcggaancactgccatcgtggagttcctggagcccctggaggcccgcaaggccttcaggcatctggcctattccaagttccatcatgtccccctctatctggagtgggctccagttggcgtcttctccagcgcagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggtgtgtggctccggggccctggggaccgggacagccgctccagcttctgcactcaccaccatgtgggctggggggcggggcggggagcggcaggcggccccaccctgcactggtccaaggtcggaggagacaggggatgaggaaggcctcaggccactgcccagcggcccaggcatcctgggtttcaccagtgacgcgttctagcagacactgactgcgcacctgctctgtagcagacacggaagagtccaagggagcagccacgttaggaagagagacttgggaacagctacacagggagctagaacccctgctccccctgtccccaccccaggagagtaaggggacgagggccagctctctggcatcaggctgcttggacatgaaaccccgtctccaagctcaagctgggagaccctggcccagtttccttatctccttgggcccagccttccccttgctagctagttcttacttcataaggttttagagagaaataaacgcagtaatgcatgaagagtg

SEQ ID NO: 10546 - DNA, 3895 bp, Homo sapiens
  misc_feature (1950)..(1950): n is a, c, g, or t
  misc_feature (1992)..(1992): n is a, c, g, or t
aggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggccgagctgcaggagaccttcggccnttttggcagcctgggccgcgtgctgctgccagagggcggaancactgccatcgtggagttcctggagcccctggaggcccgcaaggccttcaggcatctggcctattccaagttccatcatgtccccctctatctggagtgggctccagttggcgtcttctccagcgcagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggtgtgtggctccggggccctggggaccgggacagccgctccagcttctgcactcaccaccatgtgggctggggggcggggcggggagcggcaggcggccccaccctgcactggtccaagctcaagctgggagaccctggcccagtttccttatctccttgggcccagccttccccttgctagctagttcttacttcataaggttttagagagaaataaacgcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatcagca

SEQ ID NO: 10547 - DNA, 4306 bp, Homo sapiens
  misc_feature (1950)..(1950): n is a, c, g, or t
  misc_feature (1992)..(1992): n is a, c, g, or t
aggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggccgagctgcaggagaccttcggccnttttggcagcctgggccgcgtgctgctgccagagggcggaancactgccatcgtggagttcctggagcccctggaggcccgcaaggccttcaggcatctggcctattccaagttccatcatgtccccctctatctggagtgggctccagttggcgtcttctccagcgcagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggtgtgtggctccggggccctggggaccgggacagccgctccagcttctgcactcaccaccatgtgggctggggggcggggcggggagcggcaggcggccccaccctgcactggtccaaggtcggaggagacaggggatgaggaaggcctcaggccactgcccagcggcccaggcatcctgggtttcaccagtgacgcgttctagcagacactgactgcgcacctgctctgtagcagacacggaagagtccaagggagcagccacgttaggaagagagacttgggaacagctacacagggagctagaacccctgctccccctgtccccaccccaggagagtaaggggacgagggccagctctctggcatcaggctgcttggacatgaaaccccgtctccaagctcaagctgggagaccctggcccagtttccttatctccttgggcccagccttccccttgctagctagttcttacttcataaggttttagagagaaataaacgcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatcagcaaaaaaaaaaaaaaaacccgggcgattcatgtccggggcgcgacaacaggtattaaatgggcccgtgcctctgttccgacccttttggacaagggaatccggcccatggggcgatatgaaaccgcccaaa

SEQ ID NO: 10548 - DNA, 3744 bp, Homo sapiens
  misc_feature (1950)..(1950): n is a, c, g, or t
  misc_feature (1992)..(1992): n is a, c, g, or t
aggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggccgagctgcaggagaccttcggccnttttggcagcctgggccgcgtgctgctgccagagggcggaancactgccatcgtggagttcctggagcccctggaggcccgcaaggccttcaggcatctggcctattccaagttccatcatgtccccctctatctggagtgggctccagttggcgtcttctccagcgcagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagaggggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatcagcaaaaaaaaaaaaaaaacccgggcgattcatgtccggggcgcgacaacaggtattaaatgggcccgtgcctctgttccgacccttttggacaagggaatccggcccatggggcgatatgaaaccgcccaaa

SEQ ID NO: 10549 - DNA, 3710 bp, Homo sapiens
  misc_feature (1483)..(1483): n is a, c, g, or t
  misc_feature (1525)..(1525): n is a, c, g, or t
gtggcgaatccggcacgaggggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccagctcgtccaggaagtgcggcgttttctcatagacaacggggtcagcctggattccttcagccaggctgcagcagagcgaagcaagactgtgattctggtcaagaacctcccggcaggcaccctggcggccgagctgcaggagaccttcggccnttttggcagcctgggccgcgtgctgctgccagagggcggaancactgccatcgtggagttcctggagcccctggaggcccgcaaggccttcaggcatctggcctattccaagttccatcatgtccccctctatctggagtgggctccagttggcgtcttctccagcgcagccccacagaagaaaaagctccaagacacaccttcagaacccatggaaaaggacccagcagagccagaaacagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggtgtgtggctccggggccctggggaccgggacagccgctccagcttctgcactcaccaccatgtgggctggggggcggggcggggagcggcaggcggccccaccctgcactggtccaaggtcggaggagacaggggatgaggaaggcctcaggccactgcccagcggcccaggcatcctgggtttcaccagtgacgcgttctagcagacactgactgcgcacctgctctgtagcagacacggaagagtccaagggagcagccacgttaggaagagagacttgggaacagctacacagggagctagaacccctgctccccctgtccccaccccaggagagtaaggggacgagggccagctctctggcatcaggctgcttggacatgaaaccccgtctccaagctcaagctgggagaccctggcccagtttccttatctccttgggcccagccttccccttgctagctagttcttacttcataaggttttagagagaaataaacgcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatcagca

SEQ ID NO: 10550 - DNA, 2188 bp, Homo sapiens
ggcaggactttctctctgtctcaagagttgctgaagctcagcacaagttggggatcacggtgccccttcctgccactgcccgcagaggcagaacccctttacctagtgggctttttgcagttggccccagggctctggtgggtttgacattatttcatggatttgatgtttttgtttttgtttttgttttgatgggggttcagtgcctgatggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttccatggggtttggatttgtggaatacaggaagccggagcaagcccagaaagctctcaagcagctccagggtcacgtcgtggacggccacaagctggaagtgaggatctcggaacgagccactaagccagccgtgacattggctcggaagaaacaagttcccagaaagcagaccacctccaagatcctggtgcggaacatccccttccaggcccacagccgggagatccgagagctcttcagcacctttggggagttgaagacggtccgcctgccaaagaagatgactgggacaggcacacacagaggcttcggctttgtggacttcctcaccaagcaggatgcgaagagagccttcaacgccctgtgtcacagcacccacttgtacgggcggaggctggtgctggagtgggccgactccgaggtgaccctgcaggccctgcggcggaagacggccgctcactttcacgagcccccgaagaaaaagcggtctgtggtgttggacgagatcctggagcagctggaaggcagtgacagcgacagcgaggagcagacccttcagctgtgagctggcaccgagagggtgtgtggctccggggccctggggaccgggacagccgctccagcttctgcactcaccaccatgtgggctggggggcggggcggggagcggcaggcggccccaccctgcactggtccaaggtcggaggagacaggggatgaggaaggcctcaggccactgcccagcggcccaggcatcctgggtttcaccagtgacgcgttctagcagacactgactgcgcacctgctctgtagcagacacggaagagtccaagggagcagccacgttaggaagagagacttgggaacagctacacagggagctagaacccctgctccccctgtccccaccccaggagagtaaggggacgagggccagctctctggcatcaggctgcttggacatgaaaccccgtctccaagctcaagctgggagaccctggcccagtttccttatctccttgggcccagccttccccttgctagctagttcttacttcataaggttttagagagaaataaacgcagtaatgcatgaagagtgccgggcatggtgctgagccctgttcctgctctccctccagggctgctgagctagaattcccacctatgtctttccaagggactgttcacggcttgggacttggtctctgtcctgccccatcctcgtcacttgggaccacgagccctggttcagtcacccagggaagcctcccagcggctcatgaagcatcgagctccaagcccagatgccaagctccctggctgagctgaatgatgtcactcatggtggacgcgttctgctcacgggcccagagccctgtgaaatgcatcaaggtcctctccgctggccagcagcatccccaggcttctctcaggcgcccgtgttcacattttctccagcctgagacgcagcctcccgcctggaagggcctgtgccagcaccaggcagagggcaagacggagagggcagagcaagaactgcactgcatctcactgcagtctgaatctagacatcgccattccccgaggtgcgacctcagactaatgacatcctggctgagcctctgtttttctctctaggaaatgggggtgataattgtgcctacctcagatagacagtgccagaattaagtgagtcaagccaagtaaagcccagagaagattctcatcagca

SEQ ID NO: 10551 - DNA, 1870 bp, Homo sapiens
aggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggctgggtcgtcctcttcctcggaggaagaggaaagtgaagatgaagccgtgcactgtgatgaagggagtgaggccgaggaagaggattcctccgccaccccagtcctgcaggaaagagacagcaagggtgcaggccaagagcaagggatgccagctgggaaaaagagaccaccggaggccagagccgagacagagaaaccagcaaaccagaaggaacccaccacctgccacaccgtgaagctgcggggagccccgttcaatgtcacagagaaaaatgttatggaattcctggcacccctgaaaccagtggccattcgaattgtgagaaacgctcatgggaataaaacaggatacatctttgtggatttcagcaatgaagaggaagtgaagcaagctctgaaatgcaaccgggagtacatgggtgggcgctacatcgaggtgttcagggaaaagaacgtccccaccaccaagggtgcaccaaagaataccaccaaatcctggcaaggccggatactcggggagaacgaagaggaggaggacctggccgaatccggaaggctctttgtacggaacctgccctacaccagcaccgaggaggatctggagaagctcttctccaaatatggtcccctgtctgagctccactaccccatcgacagcctgaccaagaaacccaagggttttgcattcatcaccttcatgttccctgagcacgctgtgaaggcctactcggaggtggacgggcaggtattccagggcaggatgctccacgtgttaccatctaccatcaagaaggaagccagcgaggatgccagtgccctgggatcgtcgtcctacaagaagaagaaggaggcccaggacaaagccaacagtgccagctctcacaactggaacacactattcatggggccgaatgccgtggccgatgccatcgcacagaagtacaacgccaccaagagtcaagtgtttgaccacgagaccaagggcagcgtggccgtgcgcgtggctctgggggaaacccaccttccccttgctagctagttcttacttcataaggttttagagagaaataaacgcagtaatgcatgaagagtg

SEQ ID NO: 10552 - DNA, 1152 bp, Homo sapiens
aggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaagatggcaagttccgcaagtttggttttattggcttcaagtccgaggaagaggcccagaaggcacagaagcatttcaacaagagcttcatcgacacatcccggatcacagtggagttctgcaagtcattcggggacccggccaaacccagagcctggagcaaacatgcccagaaaccaagccagcccaagcagcctccaaaagactctactactccagaaattaagaaagatgagaagaagaaaaaggtggcaggtcaactggagaagctgaaggaggatacagagttccaggagtttctgtcagttcatcagaggcgggcgcaggcagccacttgggcgaatgatggcctggatgctgagccctcgaaagggaagagcaagccggccagtgactacctgaacttcgactccgattctgggcaggagagtgaggaggagggagccggggaggacctggaagaagaggcaagcctcgaaccaaaggcagctgtgcagaaggagctgtcggacatggattacctgaaatccaagatggtgaaggcctcaggccactgcccagcggcccaggcatcctgggtttcaccagtgacgcgttctagcagacactgactgcgcacctgctctgtagcagacacggaagagtccaagggagcagccacgttaggaagagagacttgggaacagctacacagggagctagaacccctgctccccctgtccccaccccaggagagtaaggggacgagggccagctctctggcatcaggctgcttggacatgaaaccccgtctccaagctcaagctgggagaccctggcccagtttccttatctccttgggcccagccttccccttgctagctagttcttacttcataaggttttagagagaaataaacgcagtaatgcatgaagagtg

SEQ ID NO: 10553 - DNA, 437 bp, Homo sapiens
taaaatctcacaaaagaagagatgcatagggaagagtctagaagagtcccaaatgtgaagtgtccattttcctataaaatcaggacatgttacccttccagtatggatatgaaatatcaacatgtgtcccactgttcagagttttattggggctccattacctagtcatgattgattgattgattgattgcccaggtggttgaactcagtctccaggttgaccgatactgtatgacgcagatgccctaccccagatcacatggttagtctttctggcatggccagcgttcacccggtgactctcagttatggtcgctaagctactagataaaaggattaggcccttattcaaactggttgaatgcttgtcaactgtcaccagagtccatccacagaataaatagaaatataagaggcaaacagacaaaaaaaaaata

SEQ ID NO: 10554 - DNA, 399 bp, Homo sapiens
tctgataaaactttatttatggacactgaaatttggatttcatataattttcatttgttatgaagtatcttcttttgactttttttcaaccattaaaaaatgaaaaaaggccagggtggcggctcacgcttataatcctagcacttcgggaggctgaggtaggaggattgcctgaggacaggagtttgagaccaacctgggcaacatagtgagacccccctaccaacctctataaaaaattagccaagcatggtagcatgtgcctgtagtcccagctacttggaagactgaggtgggaggattgcttgagcccaggagacagaggttgcatgagctatgatcatgccactgccttccagcctggatgacagagtgagaccctatctctaaaaaaaaaaa

SEQ ID NO: 10555 - DNA, 388 bp, Homo sapiens
taaaaaatacatcacattgttacatgcataatgcattcttatgtgttatgtattagtaacagtgtctataatttttaacgatggacattttggttccaagtctttgactttggttctgtatatatcctagcaaataaccccccactagaactgaagggcattttgcaggaaatgtactgaatgaaagccccattgcaactgccatgtctgcacctgtcatcctggaaactccattatgaacattctgaactgagaacttcagtggatgaggccattcaattccctatcaaaccatacatcttccagcagatccccagcccacagcattttcctcatcccccagggaccatggtttctccttccactgatggctgtaccctggggtgca

SEQ ID NO: 10556 - DNA, 311 bp, Homo sapiens
  misc_feature (280)..(280): n is a, c, g, or t
  misc_feature (285)..(285): n is a, c, g, or t
tccactgggtgtggtattcctcaagctgtttcttctggcatcggtttcagtaacgcgagtgtttccagtaagttgatttggggcaggctccgtagctgtcggtgtccatccgtcacgcctgaactccgcaggccctggcaattcttaatgttgcttggctgtgtcgtcttttttccttcattaatctcaccagaagtttgtccatttcaccagtattttattttaatttatttattttgagaggaagtcttgctgtgagccaagactgcgccactgcacntccancctgggcgaaagagcgagactcagtc

SEQ ID NO: 10557 - DNA, 422 bp, Homo sapiens
aatgcatcaaatcaaccaatgattatttaaaaacagcagctacaaaaactctgcaaagcgggtgggaatttcctgcttgggtctagcctccgtgtttcccgcgcacagcccggtctttaccctggatgcttccgaaccggcatcatctggcatctccgacagtcttgatgcgacttaacgcatggtaagaacccatcagagaaggccaaagggatttccagagacaggtagaggcactgcgctgggcagcaccagggaggaatattatcttttcaagcagctggactctgacctagaagccggaactcctgagtactgaggtcagcacctctctcacacacccccagctataagcttgaaggaagcccctccccttctctgggccttgatttcccctcctgctcagtggggacgttcttggt

SEQ ID NO: 10558 - DNA, 276 bp, Homo sapiens
acgaacatcacacgccggggcctgttgtggggtgggggactaggggagggataatattaggagaaatacctaatgtagatgacaggttgatgggtgcagctcaccaccaaggtacatgtatatctaggtaacaaaccggcacgttctgcacatgtatctgaacttaaagtataatttaaaaaaatttttaatacagcttaataagcatcctccatccagtttttgtacttactggaatgatttcacctttccatgtattaaaatcttttgcctgtt

SEQ ID NO: 10559 - DNA, 388 bp, Homo sapiens
  misc_feature (6)..(6): n is a, c, g, or t
  misc_feature (25)..(25): n is a, c, g, or t
  misc_feature (89)..(89): n is a, c, g, or t
  misc_feature (97)..(97): n is a, c, g, or t
atgaanaaaacccaaagttatccgnctggaatccataatacatgagttcctaatacacccctggtagatagaattatcctagttcttanacttttanttgttgttgagatggagttgcactccagcctggcaaaatactggtggccaggcatggtggctcatgcctgtaattctagcactttgggaggctgaggtaggtgggtagcttgagtccagcctgggcaacatagtgaaaccctgtctctaccaaaaatacaaaaattagctgggtgtggtggtgtgtgcggtagttccagctgggaggattgggtgagcccgggaggtggaggttgtggcgagccgagatggcgccattgcattccagcgtgggcaacaagagcaaaactct

SEQ ID NO: 10560 - DNA, 2595 bp, Homo sapiens
  misc_feature (466)..(466): n is a, c, g, or t
  misc_feature (1048)..(1048): n is a, c, g, or t
taaaatactttcagttttcacattttgacaactggcaatcttgaatggtcaaaaatgaattatctgtgttataccatttgggccttgtttgcttgtttttgcctctggttcttacatttatcattaaaatctccactgtagaaagcagttgggtgaagcaaggaggaaattgaaagtcaatccatatggatgttgcttagcagcttttgtaaagtacaataacaaatctccctcacaaatgagagaaactaaaaggacttgttaaataaaactccaaacttaagtctgcttctaggaattgtatttatttatcgtttcaagtatatcttttcatactgactatgagtaaagcaaagcaatagattgtttgaaagtctatagtttatgatgagctttgtcttttcttttcttcttacttcaggctttgagttacacaggtagccacatgaaagtccacttacccagnttagtagagaatgaaatcctgaaagaggatggatcaataattaaaaggtttgggttagcatggggtgatgctttgccaactaacaccataaaaatttttccaattttaagaaaagaaggggagaatccctacatctaccctaaagaggatagaaaactgcctactctcctgtattataatactttggtcaagtaatggatctattgaagtatcatccctgaagtatcctcttgatacttcaaacataatactaagtcatagcaagaatgagactcacgcttacacagtctgactccctgggttttagcaagccatcaacttagttgaagccagcctgatggtattacattgtgtcgatagattcagagagcataggaagaagaatctaatcgatggatcacagattaattttgtgaccagctatattcagctcaatcttagtaaatcattactttgaatggtatgtgctttcttttaacagctgctttatgattctgcatgtgagtggccaataacataagcatgagtttgatatccatgaaacaaatatacctagcgatgctgaaacctggggctttaatnagttaagcaagtgtcatgaaagcagtaagcagcacatttttacgcttatacaagggggctgactgtgaggcacactggtctgcccaggtctctgttatggatttgatgtataaacttgggcactgttccacagatctactctggcttctcactggtcctctaacagcactgtaagtattgagattaataaaatgtgctcagcttctcggtgaaaagacacaatggaaatccaagttacaattgtgcttctcacttcattgaaaagggagaaagattgtcattcagagtatgctacagaactattttaagcctttagaacataataattagaacagcaaaattaaaggttctgtcacaattccacccaccaatcaaatgggaaaagagcagcagctaggaatttaaaagagtgtaattgctctctcagaacttaaaaaatgctacatgaattaaggataaaatgccttttatactctcaacttttaagtcttttattcaattattcagatgaaaccacataatccacgcatgcactaacatcatgggctcttcaaacaggaatagatttagagatcaattaatccaaagttctcaattacagctggtgaatttgaagccaggaatatagacaactccatagagtttccacagctagttagttatggaagctagttagttacagaactctatttatgatgtacaacatttattttatacattgttaaagatatcatatacatgtgcatattcagaaacacattggcctacatttgcctacacagaatatcacgaaatgtcctataatggaggcttaacccctggcatcaatgctataaaggcttctactagcttttagcagaaatagtcagaaaagtgcctttttgaagaaaaaaaaaatggctgccgcgtatttaggaaaacatcagatttcaatcattggaatcaaatttgaccttttcatcagcaagaacaaatttaagtttgcttccagatgcagaacaattcatatagtattaaaggaaaaaggggagtagaagaacataagggaagaaggaagaaggaaacaaggatgtccaaaaaaaagctgaaagtattttagctgaagtaagttatttttaaaaatcaggatgatcgtaacaaatgcatagaggtattggatgatggcagaacttccaacttctgaacaatgaaaacataaggaaaatgctgggtaaagctacaaaaactgatcatttcctatggcggttttaagtgtagatgcatagtgtatggttatggactcaggctctggaatctttgactcttggtcccactgtgtgctaattctgttattttttgtttggactattgcttaaattctcggagattcaatttctttatttgttatactagtgtctggcccatacaacacattcgtcaaatacttgtggaatgaggacccgcatttggaagtgtatagtgaaaaaggctgctctgcctatggagtagccattttttattcctttgctttcctaataaacttgcttttactttactctaaaaaaaaa

SEQ ID NO: 10561 - DNA, 421 bp, Homo sapiens
ctcttaggaacaagggagaaggccaagactttaaaatctgcacttctcaaatgcatacatggaagccagtggggtttaggcagttctctttgtcctaagcttgagagagagtgtagatttccctccctggtcaacttctagtcccttcttcctaacctgaagtcctacttctgtgtctgataagcggaatcaagtgactgagaattctgctactcttttagccctgtgaccttgaataaaacgtttaatctctctaagcctattttcctatctgtaaaatggaggatttacttcctttcagggttgttttgtggattgaacaaccgtgatgttttatgtggatgaatgtaaaacacctagaataatgaatggcacgtaaaatatgttaaataaatgttagatggctttctgaaaaaaaaag

SEQ ID NO: 10562 - DNA, 289 bp, Homo sapiens
gaaaaatattgagtgttaaggcttgctgtgccagacacttggctaggtgtaggataaaagaaatagggagcttttgattacagtctagaaggtgagacacattatacatttatttgtgtgggtatctgttaagtgcgaagtgttaagtgctataaagaaaaagcatagggtagtagaagggagtttaaaaggaacacttccctgaacagaaatgggctataaactgagaccttagggatgggtaagtaacccaggccgaataagaagagtctcccaggaggaggacatg

SEQ ID NO: 10563 - DNA, 11364 bp, Homo sapiens
  misc_feature (11336)..(11339): n is a, c, g, or t
gttggttggagtggcctcactcttacctgccaacctgggaggttgatgatgaacatgtctttaccttttctttggagtttgcttaccttattaatatttgctgaagtaaatggcgaagcgtggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagttgtcactgcccacctgagacgtacggaccccagtgtgcatccaaatatgacgactgtgaagggggttctgtggcacgctgtgtccatggcatctgtgaggatttaatgcgagagcaagctggagagcccaagtacagctgcgtctgtgatgctgggtggatgtcttcacccaacagccctgcctgcacgctggacagagacgagtgcagcttccagcccgggccttgctccacacttgtgcagtgtttcaacactcaaggctctttctactgtggggcctgtccaacaggctggcaaggcaatggatatatttgcgaagatatcaatgaatgtgagataaataatggcggctgttctgtggctccacccgttgagtgtgtgaatacacctgggtcttcccactgccaggcctgtccaccagggtaccagggtgacggaagagtgtgcacactcacagacatctgctcagtcagtaatggaggctgccacccagatgcctcatgctcctcaactctaggttccttacctctctgcacgtgtctcccgggttatactggaaatggttatgggccaaatggatgtgtgcagctcagtaatatttgcctaagtcacccctgtctaaatggacaatgcatcgacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaagtttgtggagagtccctctcaggaataaatggaagcttcagctacaggagcccggatgttggttatgttcatgatgttaactgcttctgggttatcaaaactgaaatgggaaaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcgcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttggcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaagatactgtggaaagtcgatcccgccatctctcacaagcagtggtaactcattgatgctggtgtttgtgactgactccgacctcgcttatgaaggcttcttaataaactatgaagcaatcagtgcagcaacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggttgcgggggtaatctcaccacttcaagcggtacgttcatatctcccaactacccgatgccctattaccacagctctgaatgctactggtggttgaaatctagccacggcagcgcatttgaactggaattcaaagactttcacttggagcatcatccaaactgcactttagattacctggctgtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagacatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggttgtggtgggattttccaggctcccagtggagagattcattctccaaattaccccagtccttataggagcaacacagactgttcttgggtcattcgggttgacagatatcatcgtgttctcttgaacttcactgactttgatcttgaaccacaagactcttgtattatggcatacgatggcttaagctccacaatgtcccgccttgccaggacgtgtggaagggagcagctggctaaccccatcgtctcctcaggaaacagcctcttcttgagatttcagtctggcccttccagacagaacagaggcttccgagctcaattcaggcaagcctgcggaggccacatcctcaccagctcatttgatactgtttcctctccacggttccctgccaattatccaaacaatcagaactgcagctggatcattcaagcgcaacctccattaaatcatatcaccctctcttttacccactttgaacttgaaagaagcacaacgtgtgcacgtgactttgtagaaattttggatggcggccacgaagacgcgcccctccgaggccgttactgtggcaccgacatgccccatcctatcacatccttcagcagcgccctgacgctgagattcgtctctgattctagcatcagtgctgggggtttccacaccacggtcaccgcatcagtgtcggcttgtggtggaacgttctacatggctgaaggcatcttcaacagccctggctacccagacatttatccccctaatgtggaatgtgtctggaacatcatcagttcccctggcaaccggctccagctgtcttttatatctttccagttggaagactctcaggactgcagcagagattttgtggagatccgtgaaggaaatgccacgggtcacttggtgggacgatactgtggaaactccttccctctcaattattcttccatcgttggacataccctgtgggtcagatttatctcagatggttctggcagcggcacgggcttccaggccacatttatgaagatatttggcaatgataatattgtgggaactcatgggaaagtcgcctctcctttctggcctgaaaactacccacataactccaattaccaatggacagtaaatgtgaatgcatctcacgttgtccatggtagaatcttggagatggacatagaagaaatacaaaactgctattatgacaaattaaggatctatgatgggcctagcattcacgcccgcctaattggagcttactgtggtacccagactgaatctttcagctccactggaaattctttgacatttcatttttactccgactcttcaatctcggggaagggattccttctggagtggtttgcagtggatgcacctgatggtgttttacctaccattgctccaggtgcttgtggtggcttcctgaggacgggagatgcacccgtgtttctcttctccccgggctggcctgacagttacagtaatagagtggactgtacgtggctcatccaggctcccgactctaccgtggaactcaacattctttccctggacattgaatctcaccgaacgtgtgcctatgatagccttgtgatacgagatggagataataacttggcccagcagctagcagttctctgtggcagagagatccctgggcccatccggtctactggagagtacatgttcatccgcttcacctcggactccagtgtaaccagggcaggcttcaatgcatcctttcacaagagctgcggtggatatttgcatgcagacagagggatcatcacgtcccccaagtatccagagacttacccatccaacctcaactgttcttggcacgtcctggtccaaagtggcctgaccattgctgtccattttgaacagcctttccagattccaaatggagattcttcttgcaaccagggggattacttggtgctaagaaatggtcctgatatctattctccacccttgggaccccctggaggaaatggtcatttttgtggcagtcatgcttcatcaactctgttcacctcggataatcaaatgtttgttcagtttatttctgatcacagtaatgaagggcaaggatttaaaatcaaatatgaggcaaagagtttagcctgtgggggcaacgtctacatccatgatgctgattctgctgggtatgtgacctcccccaaccaccctcataattatcccccgcacgctgattgcatttggatcttagcggctccaccggaaacacgcatacagctgcaatttgaagatcgattcgatattgaagtaacacccaactgtacttccaactaccttgagttgcgggatggagtggattcggatgcaccaatactttccaaattttgtgggacatctttgcccagcagtcagtggtcctcaggagaggttatgtatttgagatttcgatctgacaacagccccacacatgtgggattcaaggccaagtattctatagctcagtgtgggggaagagtaccagggcaaagtggtgttgttgaaagcattggacatccaacacttccatacagagacaacttattctgtgagtggcatctccaggggctctctggacactatctcaccatctcttttgaagactttaaccttcagaattcttctggctgtgaaaaagacttcgtggagatctgggacaatcatacctctggaaacatcttgggcagatactgtggaaacaccattcctgacagcatagacacttctagcaatactgctgtggtcaggtttgtcacagacggctctgtgactgcctcaggattcagactgcgatttgaatccagtatggaagagtgtggtggggatcttcagggctctattggaacatttacttctcccaactacccgaacccaaatcctcatggccggatctgcgagtggagaatcactgccccggagggaaggcggatcaccctaatgtttaacaacctgaggctggccacgcatccgtcctgcaacaatgagcatgtgatagtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcagtgtgtggtgggtctcttccaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgatgctgatgggcccctgatgtggagactttgtggtccttcaaagcctacattgccattggttataccttattctcaggtatggattcactttgtcaccaacgaacgtgtagaacacattggattccatgcaaagtattcctttacagattgtggcggaatacagataggtgacagtggagtgatcacaagccccaactatccaaatgcttatgacagcctgacccactgctcttggctgttggaggccccacaagggcacaccatcactctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggtgtgggcaggaactgaggaggtggacaaagccctgctagccactggctgtgggaacgtggctccgggtcccgttatcacaccaagtaacacattcactgccgtcttccagtctcaggaggcaccagctcagggcttctccgcgtcctttgttagccgatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaagctcgttccgctgtgacgggaagctgtgtcaacgatggcgtgcacattatcagaggttacagcgtcatgtccaccccatttgctactgtgtgtggggatgagatgccagctcccctcaccatcgctgggccggttctgcttaacttctactccaacgagcaaatcacagacttcggattcaagttttcctataggataatctcctgtggtggtgtgttcaatttctcttctggaatcatcacaagtcctgcctattcatacgcagactacccaaatgatatgcactgtctgtataccatcaccgttagtgacgacaaggtgatcgagctcaagttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagcaaaaggctggaagatgtctttccggcagacattggggcctcagcaaggatgtggtggttatctgacaggctcgaataatacctttgcctctcctgattctgattcgaatggaatgtatgacaagaatttaaactgtgtatggatcataattgcacctgtaaacaaagtaattcacctcaccttcaatacatttgctctggaggcagcaagtactaggcaaagatgcctttatgattatgtaaagttatatgatggggatagtgaaaatgcgaacttggctggaacgttttgtggttccacagtacctgctccttttatctcttctggtaacttccttacggttcaattcatcagtgacttaacattagagagggaaggatttaatgctacatacaccatcatggacatgccttgtggtggaacgtacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcagattgcaacagagactatcacaaggcatttggcaacctgagaagccctggatggccagataactacgacaatgacaaggattgcaccgttactctcacagccccccagaaccacaccatttccctcttttttcattcacttggcatcgagaactcagttgaatgcagaaacgatttcttggaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggatgtggtggaactctttatggagacagaggctcattcaccagccccggctatccaggcacatacccaaacaacacgtactgcgagtgggtccttgttgctcctgctggaaggcttgtcaccatcaacttctacttcatcagcattgacgatccaggagactgtgtccagaactatctcacactctatgatgggcccaacgccagctctccatcctctggaccatactgcggaggcgacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcacgctggacagcactctgccatcctgatacatgacccctgctgatgccacagagaataagctgaacttgtatggtttttcaccaaaccatggatagaatcaatatttgtaggccaggcgtggtggctcacccccctgtattctcagcactttgggaggccgaggcaggttgatcacctgaggtcaggagtttgagactagcctggccagcatggtgaaacctcatccctctaacaatataataattagccaggcgtggtggtgggtgcctgtaattccagccactcgagaagctgaggcaggagaattgcttgaacccaggaggcagaggttgcagtgagctaagatcacaccactacactccagcctgggcgannnngtaagactccatctcaaaaaaaaaa

SEQ ID NO: 10564 - DNA, 720 bp, Homo sapiens
gttggttggagtggcctcactcttacctgccaacctgggaggttgatgatgaacatgtctttaccttttctttggagtttgcttaccttattaatatttgctgaagtaaatggcgaagcgtggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaaggtgagtcatctactctttggttaagaatgatggcaggtcagcatctgtggtttccttggaatcatcaggcatatttaattctccatctaaagtttctaggattctgtggcctcccaaatcaaattgaaatataccaggtatgctaaaacccaaacagtggtgagtatgattgtataacccaccaa

SEQ ID NO: 10565 - DNA, 3857 bp, Homo sapiens
  misc_feature (3829)..(3832): n is a, c, g, or t
agcggatcacctcctaggaaatatgcagtaagatggattgtgtgcctgaaggttaaactctttttccaacaggtattcaatggcattagaagtaactcaccccagctagagaaactgtgtagtagtgtgaatgtaagcaatgagattaaatcttcaggaaacacaatgaaagtcatttttttcacggatggatccaggccatatggcggcttcactgcttcctatacctccagtgaagatgcagtgtgtggtgggtctcttccaaatactcctgaaggaaactttacttctcctggctatgacggagtcaggaattactcaagaaacctgaactgcgaatggactctcagcaatccaaatcagggaaattcatccatttccattcactttgaagatttttacctagaaagtcaccaagactgtcaatttgatgtcctcgagtttcgagtgggtgatgctgatgggcccctgatgtggagactttgtggtccttcaaagcctacattgccattggttataccttattctcaggtatggattcactttgtcaccaacgaacgtgtagaacacattggattccatgcaaagtattcctttacagattgtggcggaatacagataggtgacagtggagtgatcacaagccccaactatccaaatgcttatgacagcctgacccactgctcttggctgttggaggccccacaagggcacaccatcactctcacatttagtgactttgatattgaaccccatacaacttgtgcttgggactctgtcactgtcaggaatggtgggtcccctgaatcacccatcataggacaatactgtggaaattcaaaccccaggacaatacagtcaggttccaatcagctggtcgtgacttttaactcagaccattcattgcaaggtggtggattttatgctacgtggaacacacaaactttaggttgtggtggaatatttcattctgataatggtacaatcagatcccctcactggcctcagaattttcccgaaaacagcagatgttcctggacggccattactcacaaaagtaaacacttggagatcagctttgacaacaacttcctaatccccagcggtgatggacaatgtcagaatagcttcgtgaaggtgtgggcaggaactgaggaggtggacaaagccctgctagccactggctgtgggaacgtggctccgggtcccgttatcacaccaagtaacacattcactgccgtcttccagtctcaggaggcaccagctcagggcttctccgcgtcctttgttagccgatgtggaagtaatttcactggcccttcaggttacatcatttctccaaattacccaaaacaatatgacaacaacatgaattgcacctatgtcatagaggctaatcctctgtcagtggtcctcttgacttttgtgtccttccacttagaagctcgttccgctgtgacgggaagctgtgtcaacgatggcgtgcacattatcagaggttacagcgtcatgtccaccccatttgctactgtgtgtggggatgagatgccagctcccctcaccatcgctgggccggttctgcttaacttctactccaacgagcaaatcacagacttcggattcaagttttcctataggataatctcctgtggtggtgtgttcaatttctcttctggaatcatcacaagtcctgcctattcatacgcagactacccaaatgatatgcactgtctgtataccatcaccgttagtgacgacaaggtgatcgagctcaagttcagtgattttgatgtggttccctccacctcctgctcccatgactacctggcaatttacgatggtgccaataccagcgatccccttcttggcaaattctgcggttccaagcgcccaccaaatgtgaagagcagcaataatagtatgctcctggtgttcaagacagattcatttcagacagcaaaaggctggaagatgtctttccggcagacattggggcctcagcaaggatgtggtggttatctgacaggctcgaataatacctttgcctctcctgattctgattcgaatggaatgtatgacaagaatttaaactgtgtatggatcataattgcacctgtaaacaaagtaattcacctcaccttcaatacatttgctctggaggcagcaagtactaggcaaagatgcctttatgattatgtaaagttatatgatggggatagtgaaaatgcgaacttggctggaacgttttgtggttccacagtacctgctccttttatctcttctggtaacttccttacggttcaattcatcagtgacttaacattagagagggaaggatttaatgctacatacaccatcatggacatgccttgtggtggaacgtacaatgcaacttggaccccacaaaatatttcatcacccaattcatcagacccagatgtcccattttccatctgtacttgggtcattgattcccctccgcatcagcaggtcaagataactgtgtgggcattacagctgacctcgcaagactgcacgcagaattacttacagcttcaggactcaccgcagggtcacggaaattcaagatttcagttctgtggcagaaatgcttcggctgtgccagtgttttattcttctatgagtactgcaatggtcattttcaaatctggagttgtaaacagaaactctagaatgagtttcacctatcagattgcagattgcaacagagactatcacaaggcatttggcaacctgagaagccctggatggccagataactacgacaatgacaaggattgcaccgttactctcacagccccccagaaccacaccatttccctcttttttcattcacttggcatcgagaactcagttgaatgcagaaacgatttcttggaggtgagaaatggaagtaacagcaattcaccattactgggcaagtactgtggaactctgctgccaaaccctgtcttctctcaaaataatgaactatacctacgatttaagagtgatagtgtaacttctgatcgtggatatgaaatcatctggacttcatcaccctctggatgtggtggaactctttatggagacagaggctcattcaccagccccggctatccaggcacatacccaaacaacacgtactgcgagtgggtccttgttgctcctgctggaaggcttgtcaccatcaacttctacttcatcagcattgacgatccaggagactgtgtccagaactatctcacactctatgatgggcccaacgccagctctccatcctctggaccatactgcggaggcgacaccagcatagctcccttcgtggcttcctcaaatcaggtcttcataaaatttcatgctgattatgcacggcgtccatccgcattccgattaacttgggacagctaagtgggtaacaactcgtgttcactcagcactttccctctgcagcacgctggacagcactctgccatcctgatacatgacccctgctgatgccacagagaataagctgaacttgtatggtttttcaccaaaccatggatagaatcaatatttgtaggccaggcgtggtggctcacccccctgtattctcagcactttgggaggccgaggcaggttgatcacctgaggtcaggagtttgagactagcctggccagcatggtgaaacctcatccctctaacaatataataattagccaggcgtggtggtgggtgcctgtaattccagccactcgagaagctgaggcaggagaattgcttgaacccaggaggcagaggttgcagtgagctaagatcacaccactacactccagcctgggcgannnngtaagactccatctcaaaaaaaaaa

SEQ ID NO: 10566 - DNA, 1352 bp, Homo sapiens
gttggttggagtggcctcactcttacctgccaacctgggaggttgatgatgaacatgtctttaccttttctttggagtttgcttaccttattaatatttgctgaagtaaatggcgaagcgtggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagaaatccttgctctaacatccccaaggaaccggaagaaggctcccgtgattggcacagagagtaagcatggcctggtgcaaaaggagctgaagacttaggaagagccggagcattgaaggggagccactgaatggccttaagtagaaaaggggacaccccaccacaccagtgtccccagctgtactctttccatgtattagcaagctcatagttttgggtaaagagagctttattcaatgctatgtcaaaatgtgaccataacgaggtcaaagattaaactgaggttcaatgaatgaagtaactctctctgaccacagtcatcattatcagtacagctctatcttctcttctgacttattctgtcaagtgacttgtccacagaattctcctgctcagctcaggcatcactttctgcaggaaactttcccttccctttttaagcagagtgaggcatctcagggcctctatgttcccatcatgctctagggatatccatcgtcaaagctttgctgatgacacacacattgtctttctaaaaacgaagtccaaaaaattaaggcagatcaatgccaaacttacttttgtacagttctttgaagtcaccttttaaactagacagtgtctttccttatagtttggctggtctcttttattttgtgatttttaaaagattaataaataaattctgctatagaatgaacaaatcctttcaa

SEQ ID NO: 10567 - DNA, 5079 bp, Homo sapiens
gttggttggagtggcctcactcttacctgccaacctgggaggttgatgatgaacatgtctttaccttttctttggagtttgcttaccttattaatatttgctgaagtaaatggcgaagcgtggagaacttgagctgcagagacaaaaaagaagcatcaatctccaacagcctcgaatggctacagagagaggaaatttggtgtttcttacggggtctgctcaaaacattgagtttagaaccggatccctgggaaaaattaaattaaatgatgaagatctcagtgagtgtttacatcagatccagaaaaacaaagaagatattatagagttaaaagggagtgcaattggtctgcctcaaaatatatctagtcaaatctatcagcttaattccaagctggtggatcttgagagaaaattccaaggcttgcagcagactgttgacaaaaaggtttgcagcagcaatccttgccagaatggtggaacctgcctcaatctgcatgattcctttttttgtatctgtcccccacagtggaagggtcctctctgctcagctgatgttaacgaatgtgagatttactcaggaacacccttgagctgccagaatggaggcacatgtgttaatacaatgggaagttacagttgtcactgcccacctgagacgtacggaccccagtgtgcatccaaatatgacgactgtgaagggggttctgtggcacgctgtgtccatggcatctgtgaggatttaatgcgagagcaagctggagagcccaagtacagctgcgtctgtgatgctgggtggatgtcttcacccaacagccctgcctgcacgctggacagagacgagtgcagcttccagcccgggccttgctccacacttgtgcagtgtttcaacactcaaggctctttctactgtggggcctgtccaacaggctggcaaggcaatggatatatttgcgaagatatcaatgaatgtgagataaataatggcggctgttctgtggctccacccgttgagtgtgtgaatacacctgggtcttcccactgccaggcctgtccaccagggtaccagggtgacggaagagtgtgcacactcacagacatctgctcagtcagtaatggaggctgccacccagatgcctcatgctcctcaactctaggttccttacctctctgcacgtgtctcccgggttatactggaaatggttatgggccaaatggatgtgtgcagctcagtaatatttgcctaagtcacccctgtctaaatggacaatgcatcgacactgtctctggttatttttgtaagtgtgactcaggttggacaggtgtcaactgtacagaaaacatcaatgagtgtttgagcaacccctgtttgaatggaggaacttgtgttgatggcgttgattctttcagttgtgaatgcacacgtctctggactggagctctctgtcaggttcctcagcaagtttgtggagagtccctctcaggaataaatggaagcttcagctacaggagcccggatgttggttatgttcatgatgttaactgcttctgggttatcaaaactgaaatgggaaaggtcctgcgtatcactttcacttttttccggttagaatccatggacaactgtccacacgagtttcttcaggtttatgatggagattcctcttctgcttttcaacttggaagattttgtggctccagcctccctcatgaactcctcagcagtgacaatgctctctattttcatctctattctgaacatttaagaaatgggagaggctttacagtaagatgggaaacacagcaaccagagtgtggaggtatcctgactggtccttacggttctattaagtctccggggtatcctggaaactatcccccaggaagagattgtgtctggattgttgtaactagtcctgacctcctggtaacatttacttttgggaccttgagcctcgagcaccatgatgactgcaacaaagattaccttgagattcgagatggtcctttgtatcaggacccccttcttgggaagttctgcaccactttctctgtcccaccgctccagactactggcccctttgccagaattcacttccattcagactcccagattagtgaccaaggcttccatatcacctacttaacatcaccttcggatctgcgttgtggtgggaactacacggacccagagggtgaactcttcttgcctgagttgtctgggcctttcactcacaccaggcaatgcgtctatatgatgaagcagccccagggagaacaaatacaaatcaacttcacccacgtggagctgcaatgccagagtgacagttctcagaattacattgaggttcgagatggtgaaaccttacttggaaaagtctgtggcaacggaaccatctctcacattaaatccattactaatagtgtctggatcaggtttaaaatagatgcttctgttgaaaaagctagtttcagagctgtttatcaagtcgcttgcggggatgaattaactggagaaggggtcattcgctcgcctttttttcctaacgtgtatcctggagaaagaacctgtaggtggaccatccaccagccccaaagccaagtcattctcctcaacttcactgtctttgaaattggaagttctgcccactgtgaaacagattatgttgagattggtagcagttccattttgggttctcctgaaaataaaaagtattgcggtacagacataccttcatttataacatctgtgtacaattttctttatgtcacattcgtgaaaagttcttctactgaaaaccatggtttcatggctaagttcagtgctgaggatttggcatgtggagaaattcttacagaatcaacagggaccattcaaagtcctggccatccaaatgtctacccccacggtatcaactgtacttggcatatattagtccaacctaatcacctgattcatttaatgttcgaaacatttcatctggagtttcattacaattgcacaaacgactacttggaagtttatgacaccgactctgagacatcccttggaagatactgtggaaagtcgatcccgccatctctcacaagcagtggtaactcattgatgctggtgtttgtgactgactccgacctcgcttatgaaggcttcttaataaactatgaagcaatcagtgcagcaacagcatgtttgcaagactacacagatgatttggggacattcacttctccaaacttccccaataattatcccaacaactgggaatgcatttatcggatcacagtgagaactggccaactgattgcagtgcacttcacaaacttctccttggaggaagccattggaaactattatacagattttctggaaatcagagatggaggctatgaaaaatcaccattgctgggaatattctatggctcaaatctacccccaacaatcatctctcatagtaacaaactatggttaaaatttaagagtgaccaaatagacacaaggtctggattctcagcttactgggatgggtcatcaacaggttgcgggggtaatctcaccacttcaagcggtacgttcatatctcccaactacccgatgccctattaccacagctctgaatgctactggtggttgaaatctagccacggcagcgcatttgaactggaattcaaagactttcacttggagcatcatccaaactgcactttagattacctggctgtatatgatggcccaagtagcaactctcatctgctaactcagctttgtggggatgagaaaccccctcttattcgttctagtggagacagcatgtttataaaactgaggacagatgaaggtcagcaaggacgtggcttcaaggctgaataccggcagacatgtgagaatgtggtaatagtcaatcaaacctatggcatcttagagagtatagggtatccgaatccttattctgaaaatcagcattgcaactggaccatccgggcaacaacaggcaacactgtgaactacacatttttagcatttgacttggaacatcacataaactgctccacagattatttagagctctatgatggaccacggcagatgggacgctactgtggagtagacctgccccctccagggagtactacaagctccaagcttcaagtgctgctccttacagatggggttggccgccgtgagaaaggatttcagatgcagtggtttgtttacggttgtggtggagagctgtctggggccacaggctccttcagcagccccgggttccccaacaggtatccaccaaacaaggagtgtatctggtacattaggacggaccccgggagtagcattcagctcaccatccatgacttcgatgtggagtatcattcaaggtgcaactttgatgtcttggagatctatggaggccccgatttccactctcccagaatagcccaactgtgtacccagagatcacctgagaaccccatgcaggtctccagcactggaaatgagctagcaattcgattcaagaccgacttgtccataaatgggagaggcttcaatgcgtcatggcaagcagtcactggaggttgtggtgggattttccaggctcccagtggagagattcattctccaaattaccccagtccttataggagcaacacagactgttcttgggtcattcgggttgacagatatcatcgtgttctcttgaacttcactgactttgatcttgaaccacaagactcttgtattatggtttaatcatacttggtcggacgtcagacagatggggtttgtatattggctctgcactgctaagcgtgtgattgggcaagtcatgtatgttttcagagctcagttttccctgctgcaaagtggaactgtaagaatcaaatgtaaacaaatgtatttaagtacctatcagtgtctggttcagataagtatttgctgctattcctaatttttctattacaatgactcctgcttctattactattaacgctatgttaaagatcttaaggaatcttttaaaaaaattttctccctgagcaagatgaaacttagtaaacaagataaaaaatccagtagaaaaa

SEQ ID NO: 10568 - DNA, 335 bp, Homo sapiens
gtaaatagcaaagagctgtcttttactggagaagccaatctgattggtttcttgattctgggattgtcatgctctgtccctcacttgtccatgtttgcccagctgtatttaaacttcaatattgcaaataattttaaattaacagcagccatttctttttaacagacaaagggagaaagttctagtttctttttatcaataaataagaatcctggttagaataaggaaattgcattaatggaaattggggctgggtgctgtggctcactcctgtactcacaaacactttgggaggccgaggcagggggatcacctgaggtcaggagtttgaaacc

SEQ ID NO: 10569 - DNA, 581 bp, Homo sapiens
tgtccctttatctacttattccagatcatctggatgatgcttaataccacaagcacctattcctctattcattcatttttagtgcatttggattttctggagcattggtcggtcctgagttgaaattcattaattgtcatggtctaatgagaaaaaataggcttaattaaaaaaatgcatctgcgtcaagtataggccaaatgatatcacagagtgctgtttttagaagggagaaaaatgttcgggaaatggggtctttatgtagcacgtggcagctcaggcatgatgaatgcaagggaatctgggccattgcagtcggcaccgtattcaaattgaaagcagcaacttagtttcagcaaaacaatataatcctttacatgccactaatgttattttgagttttattggctttgcagttttgggtttaattagtgcattcattttatagtggtatgagactacaagcatataaatcattttgtatttctatatatttaagtgagttataataaaaataactggtcaaccctggaggtccttgaggatttttttttctttaaaaggaaagtaccttattcaag

SEQ ID NO: 10570 - DNA, 337 bp, Homo sapiens
taactttaagtagactatctactgctactaggaaacagaagattttgcttaggagacagatttttgtaaaagttggggaaaccataagaggctttgccaatctttttgcctagaaaagtgtaaaatgaaaaccaggattctgtaattattattgaagttgtctgctttctgattaacacattcagaaagagagaggcttgtatctgtcaagcaagtatctttcaagagacacttttcaggcaaagaaaaagtcacaactggcattgaagctgagggtcatagtgattttttttttaaagctttctgattaaaataaaagaacaaccgttccatgagg

SEQ ID NO: 10571 - DNA, 2051 bp, Homo sapiens
  misc_feature (1)..(1): n is a, c, g, or t
ncagcgcctccgcacctggtaggtgctcagttaacgtgggagaaatgaagagtgaaggtgccgcacatcttggatattctccaggacatggtgggcgggtgctatgagttttcctgttctgcagatgaagaggctgcggctcaggaatatgaacaacccggccaaagccacaaaacaaggaagcaccggcagggccgggattcaggtctgggtttgtctgactccagagcccagtgccttgttctccatggctgctgtgtgctacctctttgatgaacatctagatttgtgtccttctctgaggggtccccagatttcagcagttcgaggccagctcagcttttcctttcaccaatggcctagaagaggccaacaaggtagctttgaggctgccccaaagtggagagtggcagtgaaacattggacgccagagtgagggccacagcgcagtggcctatatgggtttagagcgtgaggcctccacgtggacttgaatgcagaccccaggcctgcccgtgttgaccttgggcaagtgacttaacctctctgagcctccattgccccacctgtaaaatgaggggtttatagtacctgcttcataaagttgctatggagatgacacgagaagccataggaccccggtgccatttggaggacccctcgtggggggcacttttcccaggccaggcacccccttcatcccggagcccctcagtggcttggaactcctccgtctcagacccagcttcaacagagtggcccagggctgggtccgtaacctcccagagtccgaggagctgtagccctagcctgaatcttcagttccccagtctcgggggcctggtaacatccggagccaagacttgtggacagcacttcacagttgaagaagggccttcacacacaaaacctgattgcaaatggcttcagaggtcaccaagttcagtcgtcccaaaacatgggtgtgtttcaaaattacctggggatgttgttccaaatccagacaactggactgtcccagacttgcagcatcagagtctcctgagtcgaggaatctgtattattaatagcaaccagggccgggtgtcgtggctcacgcctgtcatcccagcactttgggaggccgaggcaggaggatcacctgaggtcaggagtttgagaccagtctggccaaaatagtggaaccccgtcgctactaaaaatacaaaaatgagtcggacatggtggtgcatgcctgtaatcccagctacttgggaggctgagacaggagaatcacttgaactaggaggcagaggttgcagtgagccgagattgcgccactgcaccccagcctggacaacagagtgagactccttctcaaaagtaaataaataaatagcaaccagtactccaggtgattccagcataacttatccatggtttgtgtcattaggagtccacatccacacctctgctctttcctgttcctgtagtgtacactcccccggtgacagggtgctcactggcaccccatcttcctgtgaataactcaaataattagaaaatgttccttttactgagatgcagttggtcttcatctattcatgctctaaacagttcctaagcgctgactgtgcgctagacactgccaggcccgggcctcgaggaggaaaagacagtagggaagacattatagagcatgaagtcaccataattttccctaaagcatgcttattgacaattgaggaacaaagtgttgtggagcagaagaaggagtccctcaccctaggtgtgagatgggattctggaagcttcctgaaggatttgagtgggaccttgtgggaggcgtgagagtccatgaagggggtgtgagggggagggtatttctggaaagtggaccagcatgtgcaaaaatatgtaactgcagccaccaggtatgaaaaggagcctggtggggagaccactgcacccaaaacaaatcctttcttcttctgagaatgtgactttttctggtgttgtaaaaaagaaaaaaaaaagaatgctcattgtaaaaataaaaaaataataataag

SEQ ID NO: 10572 - DNA, 3290 bp, Homo sapiens
  misc_feature (1)..(1): n is a, c, g, or t
ncagcgcctccgcacctggtaggtgctcagttaacgtgggagaaatgaagagtgaaggtgccgcacatcttggatattctccaggacatggtgggcgggtgctatgagttttcctgttctgcagatgaagaggctgcggctcaggaatatgaacaacccggccaaagccacaaaacaaggaagcaccggcagggccgggattcaggtctgggtttgtctgactccagagcccagtgccttgttctccatggctgctgtgtgctacctctttgatgaacatctagatttgtgtccttctctgaggggtccccagatttcagcagttcgaggccagctcagcttttcctttcaccaatggcctagaagaggccaacaaggtagctttgaggctgccccaaagtggagagtggcagtgaaacattggacgccagagtgagggccacagcgcagtggcctatatgggtttagagcgtgaggcctccacgtggacttgaatgcagaccccaggcctgcccgtgttgaccttgggcaagtgacttaacctctctgagcctccattgccccacctgtaaaatgaggggtttatagtacctgcttcataaagttgctatggagatgacacgagaagccataggaccccggtgccatttggaggacccctcgtggggggcacttttcccaggccaggcacccccttcatcccggagcccctcagtggcttggaactcctccgtctcagacccagcttcaacagagtggcccagggctgggtccgtaacctcccagagtccgaggagctgtagccctagcctgaatcttcagttccccagtctcgggggcctggtaacatccggagccaagacttgtggacagcacttcacagttgaagaagggccttcacacacaaaacctgattgcaaatggcttcagaggtcaccaagttcagtcgtcccaaaacatgggtgtgtttcaaaattacctggggatgttgttccaaatccagacaactggactgtcccagacttgcagcatcagagtctcctgagtcgaggaatctgtattattaatagcaaccagggccgggtgtcgtggctcacgcctgtcatcccagcactttgggaggccgaggcaggaggatcacctgaggtcaggagtttgagaccagtctggccaaaatagtggaaccccgtcgctactaaaaatacaaaaatgagtcggacatggtggtgcatgcctgtaatcccagctacttgggaggctgagacaggagaatcacttgaactaggaggcagaggttgcagtgagccgagattgcgccactgcaccccagcctggacaacagagtgagactccttctcaaaagtaaataaataaatagcaaccagtactccaggtgattccagcataacttatccatggtttgtgtcattaggagtccacatccacacctctgctctttcctgttcctgtagtgtacactcccccggtgacagggtgctcactggcaccccatcttcctgtgaataactcaaataattagaaaatgttccttttactgagatgcagttggtcttcatctattcatgctctaaacagttcctaagcgctgactgtgcgctagacactgccaggcccgggcctcgaggaggaaaagacagtagggaagacattatagagcatgaagtcaccataattttccctaaagcatgcttattgacaattgaggaacaaagtgttgtggagcagaagaaggagtccctcaccctaggtgtgagatgggattctggaagcttcctgaaggatttgagtgggaccttgtgggaggcgtgagagtccatgaagggggtgtgagggggagggtatttctggaaagtggaccagcatgtgcaaaaatatggaactgagcacgggtgcagggtgttctgcagaagggagaaggctgtgctagaggagccagtgagggccagcatggggtgggcttcactaaggaaatggggaaggttttagtgatgggtcttgctgggtgctgtgtggggcgcatattggagaagggtaatgccagaagccaggaagcctgcaagggatgaggccatgggaatggagagaaggggccacccactgggcacctaacaggacaggtgcaaagtggggtgcttattaagattccttctttccactccattttgagcaggctgcttaaagtggtggtgatgatgatgatgatgatggcagctttatatcgagtgcctcagtgcttgggctggtagtagtttctctacatatcttatttctaattctcagaacaaccctgagagaaagatattgttgtccccactttacagatgtggatatttaggccaaaaggaggaagtgacttgtccaggggcagacaccaaatgggaatctgattccagtggatgtctcttttcagtgcactgggtggtcaatgcccactcgctctgaaatcatctgactgtgatgccctgccttggagtttagaagttgagtgcaggcttgggagtcagactggatggggtaggttctaactctgccactgctagccggatgaacttgagcaagtcatttcacatctccgagcctctgtttctccaagtgtaagatgaggacaagtataaaacctcctttatgggtttgttgtgaacacagtgcagggcacatttataataagagctcagtcaatggtaggtttcatgcaactgctgctctaggctggaaaagttgttcttgcactggatgcagcatgagaagctggctgctaagatgtcactgggggtcactaaagctgaagcctgaaggaaagcctctcattgctgtagagctctccctgcctctctctctgggggcgatggggaaggtcaggagtccagcccattcccagggtgtgtgggatagcgattgcattttccttttgctctggagtttcactccccttctgggtcccaagggcccaatggcctgacttttagaattgcttgcaattggtgttttctcttgaatttgggggctgccatttaaagccaggtttccatgagctgaagaccagccattcaagaatctgaaaagtagacaagaggactccagttgcctcaggttggttctgctgtgctctggaaagtaactgcagccaccaggtatgaaaaggagcctggtggggagaccactgcacccaaaacaaatcctttcttcttctgagaatgtgactttttctggtgttgtaaaaaagaaaaaaaaaagaatgctcattgtaaaaataaaaaaataataataag

SEQ ID NO: 10573 - DNA, 3002 bp, Homo sapiens
  misc_feature (1)..(1): n is a, c, g, or t
ncagcgcctccgcacctggtaggtgctcagttaacgtgggagaaatgaagagtgaaggtgccgcacatcttggatattctccaggacatggtgggcgggtgctatgagttttcctgttctgcagatgaagaggctgcggctcaggaatatgaacaacccggccaaagccacaaaacaaggaagcaccggcagggccgggattcaggtctgggtttgtctgactccagagcccagtgccttgttctccatggctgctgtgtgctacctctttgatgaacatctagatttgtgtccttctctgaggggtccccagatttcagcagttcgaggccagctcagcttttcctttcaccaatggcctagaagaggccaacaaggtagctttgaggctgccccaaagtggagagtggcagtgaaacattggacgccagagtgagggccacagcgcagtggcctatatgggtttagagcgtgaggcctccacgtggacttgaatgcagaccccaggcctgcccgtgttgaccttgggcaagtgacttaacctctctgagcctccattgccccacctgtaaaatgaggggtttatagtacctgcttcataaagttgctatggagatgacacgagaagccataggaccccggtgccatttggaggacccctcgtggggggcacttttcccaggccaggcacccccttcatcccggagcccctcagtggcttggaactcctccgtctcagacccagcttcaacagagtggcccagggctgggtccgtaacctcccagagtccgaggagctgtagccctagcctgaatcttcagttccccagtctcgggggcctggtaacatccggagccaagacttgtggacagcacttcacagttgaagaagggccttcacacacaaaacctgattgcaaatggcttcagaggtcaccaagttcagtcgtcccaaaacatgggtgtgtttcaaaattacctggggatgttgttccaaatccagacaactggactgtcccagacttgcagcatcagagtctcctgagtcgaggaatctgtattattaatagcaaccagggccgggtgtcgtggctcacgcctgtcatcccagcactttgggaggccgaggcaggaggatcacctgaggtcaggagtttgagaccagtctggccaaaatagtggaaccccgtcgctactaaaaatacaaaaatgagtcggacatggtggtgcatgcctgtaatcccagctacttgggaggctgagacaggagaatcacttgaactaggaggcagaggttgcagtgagccgagattgcgccactgcaccccagcctggacaacagagtgagactccttctcaaaagtaaataaataaatagcaaccagtactccaggtgattccagcataacttatccatggtttgtgtcattaggagtccacatccacacctctgctctttcctgttcctgtagtgtacactcccccggtgacagggtgctcactggcaccccatcttcctgtgaataactcaaataattagaaaatgttccttttactgagatgcagttggtcttcatctattcatgctctaaacagttcctaagcgctgactgtgcgctagacactgccaggcccgggcctcgaggaggaaaagacagtagggaagacattatagagcatgaagtcaccataattttccctaaagcatgcttattgacaattgaggaacaaagtgttgtggagcagaagaaggagtccctcaccctaggtgtgagatgggattctggaagcttcctgaaggatttgagtgggaccttgtgggaggcgtgagagtccatgaagggggtgtgagggggagggtatttctggaaagtggaccagcatgtgcaaaaatatggaactgagcacgggtgcagggtgttctgcagaagggagaaggctgtgctagaggagccagtgagggccagcatggggtgggcttcactaaggaaatggggaaggttttagtgatgggtcttgctgggtgctgtgtggggcgcatattggagaagggtaatgccagaagccaggaagcctgcaagggatgaggccatgggaatggagagaaggggccacccactgggcacctaacaggacaggtgcaaagtggggtgcttattaagattccttctttccactccattttgagcaggctgcttaaagtggtggtgatgatgatgatgatgatggcagctttatatcgagtgcctcagtgcttgggctggtagtagtttctctacatatcttatttctaattctcagaacaaccctgagagaaagatattgttgtccccactttacagatgtggatatttaggccaaaaggaggaagtgacttgtccaggggcagacaccaaatgggaatctgattccagtggatgtctcttttcagtgcactgggtggtcaatgcccactcgctctgaaatcatctgactgtgatgccctgccttggagtttagaagttgagtgcaggcttgggagtcagactggatggggtaggttctaactctgccactgctagccggatgaacttgagcaagtcatttcacatctccgagcctctgtttctccaagtgtaagatgaggacaagtataaaacctcctttatgggtttgttgtgaacacagtgcagggcacatttataataagagctcagtcaatggtaggtttcatgcaactgctgctctaggctggaaaagttgttcttgcactggatgcagcatgagaagctggctgctaagatgtcactgggggtcactaaagctgaagcctgaaggaaagcctctcattgctgtagagctctccctgcctctctctctgggggcgatggggaaggtcaggagtccagcccattcccagggtgtgtgggatagcgattgcattttccttttgctctggagtttcactccccttctgggtcccaagggcccaatggcctgaccaggcttcagtggggtaccga

SEQ ID NO: 10574 - DNA, 741 bp, Homo sapiens
gcatgacaagaccagttagggattgttggttgcaggatacagtgatcatttagtagatctgatcaatcaaaagagctacaatccaaaagcaactattgggaaaggcctagaagcatctctaggaccattgtttcttagacctatactcatagaattgcctctcttctcagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacaggaagtgatggtgtctgcttcttttgctgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10575 - DNA, 1194 bp, Homo sapiens
ggacttcccagtctcgtgagtcatacaactctcaggcctgtgctgcaaatgacacttgcttaggagtaaggtgaagggtattttatagctctaatggtttgtacagttcttaaacatgtattgattgctaacaactgctgtctttctcccagcttgccccaccaccagtctttgtgcataagcacaattttggacatagttatttgtacttatttatgcttttacaccttcttccttttataaagattttagctggtttatgacttgagttgaaacaaggaaaaaaagaggagacctgaaatggtctgtcccctgccaaccagaagcctcctgtggtatccaaacagaatagttgcctcagtctgtcagcacttctgtctttgaaggtggtttctgcttgaaaagtggtgactattagcatagcctggggataattgcttttttttcttctctcgggatacctttttttttttttttttccagatactttcttgctcttgtcgactttgtttttccagaagatttagcctgtggttaaaatgtttcgggtccccacgtgaactctctgtgggattacccaattctggggtaccttcaccagatcaccagtgctaaagagggcaaaggatcttcttggttaatagaaaaggctgttttggaatgaatctcaaagtccagaaacatcgagacttttcttcaatacttttttctatttggggtagcaactttacctagtgtaggggagggaggggttagttgggagggcttgtgtttaaggggttcagaaacaggggatttaagtgtgtcttttgtgtttgcaaggcactaacaccactcccgtctgtatttaaatgctgtccccaggttacgactatggctatgtctgcgtggagttttcactcttggaagatgccatcggatgcatggaggccaaccaggttgctttatacttcggtcaaatgatgctggaaggatatatttttttatatatggggagggagggtttcaaatgattttactttggaaaggtacaagaagtctatctgtggagcatactgtattccaaccatcggttgtgaggaaaatctttaaaaaggctggaaagctttctctagaaaacttaatgggcacagagtgcattttaaaagctagagcccagttgcttttggactagattccaaagacaatagttgg

SEQ ID NO: 10576 - DNA, 336 bp, Homo sapiens
aaaattagctgggcgtggtggtgggcacctgtagtcccagctacttgggaggctgaggcaggagaatggtgtgaacccgggaggcggagcttgcagtgagctgagatcacgccaccgcactccagcctgggcgacagagcaagactccgtctcaaaaaaaaaaaaaaaaaaaaaaaagagtcttactgctcattctttcaggagtgtctggaccacccaacctgcttgctgtctaggttggttcctttcactgcaaaatgaggaacagaggatttctcgataggaactgtaggattaagtactcgtcaaatgccacttggtagcagccttaagaat

SEQ ID NO: 10577 - DNA, 4010 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcggactgggtgaaagctttttctgcagcagtcatgttgaaaaccttgtgttgactttcctcgtgttctgaaatgggagcataaaagtttactccgccacttcgtcttaaaatagcaaaactttgctgttttctgcagatctaggaccttgttacagaactctgccaaaaaaaaatgtttacagaagaatgtgctgtgattagagaagaatatgctggtgtgtagatttcaaactctctggacaatatgaataacactgtctttgtttctacagtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10578 - DNA, 3875 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgatctaggaccttgttacagaactctgccaaaaaaaaatgtttacagaagaatgtgctgtgattagagaagaatatgctggtgtgtagatttcaaactctctggacaatatgaataacactgtctttgtttctacagtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10579 - DNA, 3774 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaaggagtgtctggaccacccaacctgcttgctgtctagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10580 - DNA, 3906 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagagaggtaaagcattatttgacagatgtatggattcaagcaagaaactgaggtccaattgcaaagaaatggcttgtataactcagagccctgtctgaggaaacacagaggaccctagagggcggagaatgaacacagcgcaggggctagttccagagtcgcattctcgggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10581 - DNA, 4137 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaagtaagtagtttgtcagggcacataccagactgtgatcatcacaatggagcatagatggccaatgttatgtccgggagctatctgctttccagtaccctgagagatctgtgcatgacctgatgacagaggccattgctgtctgtggaccttcctgtactgcttaaaggaatctatgcccttcaaatagtaaattgctatatgaatgcagtaaggcatgattttagatttctaagtattggtgaagaaaagtatgcagtatttatttgtttagcatttttttacagaaccagccttgctagtagcatctatagtaaaaaatgacagtcagattcttgggacttcaaaaatttatctttctctcccttgtgttgcccttctcccatttatggttgattcagctatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10582 - DNA, 2226 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10583 - DNA, 2386 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10584 - DNA, 1782 bp, Homo sapiens
gcaacacgggaaaagctatgaccgggaggcgcgatccgcccgggagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaaggagtgtctggaccacccaacctgcttgctgtctagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10585 - DNA, 1241 bp, Homo sapiens
tatctagagatcccctgctgctccctcttcactgggggaagctggtgcggctacggcttgtggcctccaacaaggagttgtcggggacgcggggagtctcatagagtaggacgttgagtgtctcctcatagattcgggcctctgggaaactgaaacattctgtagacttacttgtttccaactgtatcgcagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10586 - DNA, 3676 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggatgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10587 - DNA, 3566 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10588 - DNA, 3477 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10589 - DNA, 715 bp, Homo sapiens
gcatgacaagaccagttagggattgttggttgcaggatacagtgatcatttagtagatctgatcaatcaaaagagctacaatccaaaagcaactattgggaaaggcctagaagcatctctaggaccattgtttcttagacctatactcatagaattgcctctcttctcagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10590 - DNA, 2592 bp, Homo sapiens
  misc_feature (2576)..(2576): n is a, c, g, or t
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggtgagtttcctccaccttggattggcctagagacagatggctaaagaaccttcaagaaggtttgactgggggccgggcctggtggcttacgcctgtaatcccagcactttgggaggccgaggtgggtggatcacgaggtcaggaaatcaagaccatcctggctaacacggtgaaaccctgtctctactaataccngttgcttggccgtgtg

SEQ ID NO: 10591 - DNA, 2990 bp, Homo sapiens
  misc_feature (2974)..(2974): n is a, c, g, or t
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaagtaagtagtttgtcagggcacataccagactgtgatcatcacaatggagcatagatggccaatgttatgtccgggagctatctgctttccagtaccctgagagatctgtgcatgacctgatgacagaggccattgctgtctgtggaccttcctgtactgcttaaaggaatctatgcccttcaaatagtaaattgctatatgaatgcagtaaggcatgattttagatttctaagtattggtgaagaaaagtatgcagtatttatttgtttagcatttttttacagaaccagccttgctagtagcatctatagtaaaaaatgacagtcagattcttgggacttcaaaaatttatctttctctcccttgtgttgcccttctcccatttatggttgattcagctatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggtgagtttcctccaccttggattggcctagagacagatggctaaagaaccttcaagaaggtttgactgggggccgggcctggtggcttacgcctgtaatcccagcactttgggaggccgaggtgggtggatcacgaggtcaggaaatcaagaccatcctggctaacacggtgaaaccctgtctctactaataccngttgcttggccgtgtg

SEQ ID NO: 10592 - DNA, 1473 bp, Homo sapiens
cattgagcccctggatgctgttgcgtggcttagatgacttatacatgctttgtggcatgattcatactaccttctaccttctatgatacccttgggtagttataataggacccaggttagagtgcttcttggtggagccactgtagaactgggatttagatgcagccagggctgatgctcagctggtgaacactggtgtgcttgttcctactggtgatttacaaccagtgtttcttctttttgggcctgcatccattttgattgggtggtgtccatgctgtatctgtaataaaatatttttgaatgttaccgctggatgcagcgtgagaaagatacctcctgaaacttactgtaagaaatttacagtgcattgatttttctgatatataggaatcgtcatgttgaccttggaattcttaagttccctggctgtaggaaatggaaatttttgtagtatgtcaccattgttagcttatttggtattgcggattttccctgttgcaggactgggtgaaagctttttctgcagcagtcatgttgaaaaccttgtgttgactttcctcgtgttctgaaatgggagcataaaagtttactccgccacttcgtcttaaaatagcaaaactttgctgttttctgcagatctaggaccttgttacagaactctgccaaaaaaaaatgtttacagaagaatgtgctgtgattagagaagaatatgctggtgtgtagatttcaaactctctggacaatatgaataacactgtctttgtttctacagtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggacaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggagaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10593 - DNA, 116 bp, Homo sapiens
gaggggaggtggcagaaattcagactggtcttcagatacaaatcgacaaggacaacagtgtaagtaacctttgttttatttctgttgctcttttttgcttgacttgctactcatta

SEQ ID NO: 10594 - DNA, 466 bp, Homo sapiens
ctgacatctattctgattcctgttccaatcagtccttcattaaaagttgcctgtttctgccagtatgctcttactgttaaaattttgacagaatataatgtagtaaatttatcctctgagaaggaaaatccacgttcacttctctttcaaaggagaatttttctgtctttgggttctggcattttctgtctctgggttcaagtgtgtctggttctataggaagctcttcgtgtggtgaagatcttacagaaccttgatccgccatttagcattgatgggaagatggtagctgtaaacctggccactggaaaacgaaggtaaggcagaagggtgaggatctcttgtgctgcccccacttgtgtttttgagaggaaactccttttcctggctggaaaaacagtaaagcatgatgttttcctaacatggactgcttcagataggtgtttattacagtttatttctgaag

SEQ ID NO: 10595 - DNA, 349 bp, Homo sapiens
attataggcgtgagccaccgcacccagcccagcctttatcagttattatgagtgaatatcatgtgagagttacctctggtttgatcagtttcaggaaaatgccagtgaagggaaggcccctgcagaagacgtctttaagaagcccctgcctcctactgtgaagaaggaagagagtccccctccagtaagaccaacattgatcccctggacctagggctggggctggggatggttccgagtagaagaggaagcgcaaaggctgatgccttcctctggtgttggtcttttacctcactatgtctcccgaataaggattcccatttcttttgagtacaagcatgagataaag

SEQ ID NO: 10596 - DNA, 3739 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10597 - DNA, 4219 bp, Homo sapiens
cattgagcccctggatgctgttgcgtggcttagatgacttatacatgctttgtggcatgattcatactaccttctaccttctatgatacccttgggtagttataataggacccaggttagagtgcttcttggtggagccactgtagaactgggatttagatgcagccagggctgatgctcagctggtgaacactggtgtgcttgttcctactggtgatttacaaccagtgtttcttctttttgggcctgcatccattttgattgggtggtgtccatgctgtatctgtaataaaatatttttgaatgttaccgctggatgcagcgtgagaaagatacctcctgaaacttactgtaagaaatttacagtgcattgatttttctgatatataggaatcgtcatgttgaccttggaattcttaagttccctggctgtaggaaatggaaatttttgtagtatgtcaccattgttagcttatttggtattgcggattttccctgttgcaggactgggtgaaagctttttctgcagcagtcatgttgaaaaccttgtgttgactttcctcgtgttctgaaatgggagcataaaagtttactccgccacttcgtcttaaaatagcaaaactttgctgttttctgcagatctaggaccttgttacagaactctgccaaaaaaaaatgtttacagaagaatgtgctgtgattagagaagaatatgctggtgtgtagatttcaaactctctggacaatatgaataacactgtctttgtttctacagtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10598 - DNA, 3069 bp, Homo sapiens
ttacatagaggatcccggcttcgtgtagggtactcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10599 - DNA, 3665 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10600 - DNA, 1438 bp, Homo sapiens
ttttttttttttacctctgtcaatgattcttttgagaaaagcacccataatttgctacttgaggattttattccctggattctctggatgctcattgcatgaaaagtggaaaagtttagatctatggaaacagaactgttgcctatatggaaaatcagtgccttgtggcaatacaggtaagaacagtgttgctcttgaaaaagtggacagtgggtggtctgaatgtgtcctggtccctggagtgggtttttagattgatgtggactcttcttagacttgtaagtaaaaaagttgtttcttcccctaaaagggaactgtgcgccttagacctggaattgctgggaaactgaaacattctgtagacttacttgtttccaactgtatcgcagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10601 - DNA, 2239 bp, Homo sapiens
ttttgataaagctttctagagattctctttgtttctgttccactagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaagtaagtagtttgtcagggcacataccagactgtgatcatcacaatggagcatagatggccaatgttatgtccgggagctatctgctttccagtaccctgagagatctgtgcatgacctgatgacagaggccattgctgtctgtggaccttcctgtactgcttaaaggaatctatgcccttcaaatagtaaattgctatatgaatgcagtaaggcatgattttagatttctaagtattggtgaagaaaagtatgcagtatttatttgtttagcatttttttacagaaccagccttgctagtagcatctatagtaaaaaatgacagtcagattcttgggacttcaaaaatttatctttctctcccttgtgttgcccttctcccatttatggttgattcagctatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10602 - DNA, 1296 bp, Homo sapiens
atctagaggatccctgcactggtagatcgctcgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacagtgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10603 - DNA, 3765 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagagggaaagtttaaaggaagaggaaatgatcgcagggaaaagctccagtcttttgactctccagaaaggaaacggattaagtactccagggaaactgacaggaagtgatggtgtctgcttcttttgctgatcgtaaacttgttgataaagaagatatcgacactagcagcaaaggaggctgtgtccaacaggctactggctggaggaaagggacaggcctgggatatggccatcctggattggcttcatcagaggaggctgaaggccggatgaggggccccagtgttggagcctcaggaagaaccagcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatgtga

SEQ ID NO: 10604 - DNA, 3301 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaacgtccgtatcatcaagaacagaacaggccctatggggcatacctatggctttattgacctcgactcccatgcggaagctcttcgtgtggtgaagatcttacagaaccttgatccgccatttagcattgatgggaagatggtagctgtaaacctggccactggaaaacgaagaaatgattctggggaccattctgaccacatgcattactatcagggtaaaaaatatttccgagataggaggggaggtggcagaaattcagactggtcttcagatacaaatcgacaaggacaacagtcatcatctgactgctacatatatgattctgctactggctactattatgaccccttggcaggaacttattatgaccccaatacccagcaagaagtctatgtgccccaggatcctggattacctgaggaagaagagatcaaggaaaaaaaacccaccagtcaaggaaagtcaagtagcaagaaggaaatgtctaaaagagatggcaaggagaaaaaagacagaggagtgacgaggtttcaggaaaatgccagtgaagggaaggcccctgcagaagacgtctttaagaagcccctgcctcctactgtgaagaaggaagagagtccccctccacctaaagtggtaaacccactgatcggcctcttgggtgaatatggaggagacagtgactatgaggaggaagaagaggaggaacagacccctcccccacagccccgcacagcacagccccagaagcgagaggagcaaaccaagaaggagaatgaagaagacaaactcactgactggaataaactggcttgtctgctttgcagaaggcagtttcccaataaagaagttctgatcaaacaccagcagctgtcagacctgcacaagcaaaacctggaaatccaccggaagataaaacagtctgagcaggagctagcctatctggaaaggagagaacgagaggagggaacatgcgaaccggtactcccttgacc

SEQ ID NO: 10605 - DNA, 2337 bp, Homo sapiens
agtaagagtctgcgggaccggcagctgtacttcatctcccagcgggccgagcgctgaaggcagcggcgcggcgcctttgtggtagcagtggccccgcgcggaggaagttccggtgtccgcggcgctgggtcggtggcggaggctgaggagaaggaggagcgggccgtggaggcttcgccgcctaggtactgctataaccagaatttggtagaaaaaggatttacttgttggggccctcttgataaaaagagatgtggggggattctcgacctgctaacagaactggaccttttcgtgggagccaagaagaaaggtttgctcccgggtggaacagggattatcctcctcctccccttaagagtcatgctcaagagagacactctggcaactttcctggcagagattcacttccctttgatttccaggggcattcggggcctccttttgcaaatgtagaggagcattctttcagctatggagctagagacggaccgcatggtgactatcgaggaggggagggacctggacatgatttcagggggggagatttttcgtcttctgatttccagagcagagattcatcacagttggacttcaggggtagggacatacattctggggattttcgggatagagaaggaccacctatggactataggggtggagatggtacttctatggattatagaggtagggaggcacctcatatgaactacagagacagggatgctcacgctgttgacttcagaggtagggatgctcctccatctgacttcaggggccggggcacttatgatttagattttagaggccgggatggatcccatgcagattttaggggaagggatttatcagatttggattttagggccagagaacagtcccgttctgattttaggaatagagatgtatctgatttggactttagagacaaagacggaacacaagtagactttagaggccgaggttcaggtactactgatctagactttagggacagggatacgccacattcagatttcagaggtagacaccgatctaggactgatcaggattttaggggcagagagatgggatcttgtatggaatttaaagatagggagatgccccctgtggatccaaatattttggattacattcagccctctacacaagatagagaacattctggtatgaatgtgaacaggagagaagaatccacacatgaccatacgatagaaaggcctgcttttggcattcagaagggagaatttgagcattcagaaacaagagaaggagaaacacaaggtgtagcctttgaacatgagtctccagcagactttcagaacagccaaagtccagttcaagaccaagataagtcacagctttctggacgtgaagagcagagttcagatgctggtctgtttaaagaagaaggcggtctggactttcttgggcggcaagacaccgattacagaagcatggagtaccgtgatgtggatcataggctgccaggaagccagatgtttggctatggccagagcaagtcttttccagagggcaaaactgcccgagatgcccaacgggaccttcaggatcaagattataggaccggcccaagtgaggagaaacccagcaggcttattcgattaagtggggtacctgaagatgccacaaaagaagagattcttaatgcttttcggactcctgatggcatgcctgtaaagaacttgcagttgaaggagtataacacaggttacgactatggctatgtctgcgtggagttttcactcttggaagatgccatcggatgcatggaggccaaccagggaactctaatgatccaggacaaagaagttaccctggagtatgtatcaagcctggatttttggtactgcaaacgatgtaaggcaaacattggtgggcaccgatcttcctgttcattctgcaagaacccaagagaagtgacagaggccaagcaagaattaataacctaccctcagcctcagaaaacatccataccagcaccattggaaaaacagcccaaccagcccctaagaccagctgataaggaacctgaacccaggaagagggaagaaggccaagagtcacgcttaggacatcaaaagagagaagcagaaaggtatctgcctccttctcgaagggaagggccaactttccgaagagaccgagagagggagtcatggtctggagagacacgccaggatggagagagcaaaactatcatgctaaagcgtatctatcgttccacaccacctgaggtgatagtggaagtgctggagccctatgtccgccttactactgccaaccgttgacaggggatccttatgagtcgac

SEQ ID NO: 10606 - DNA, 379 bp, Homo sapiens
tttttttttttgagatggagttttgctctttgttgcccaggctggagtgaagtggcacgatcttggctcactgcaacctccatctcccaggttcaagcgattctcctgacccagccgcatgagtaactgggattacaggagcccaccaccacacccggctaatttttgtatttttagaagagacagggtttcactatgttggccaggctggtctcgaactcctgacctcgtgatctacccgcctctgcctcccaaagtgctgagattacaggcgtgagccaccgcaccccgccagtgtttcttaaagagttagcatatttaaagaattggatgttttgggcttaatttcttattttttccctgggattcttagagaccc

SEQ ID NO: 10607 - DNA, 443 bp, Homo sapiens
cctgtgatcaattaagcagctgaccaatcattacctcctcttccctgctctttctacccagtaaatacaaagggctgtagaagctcagagctgctgcttttgctcagtagaagcagggagtcctcttcttcttcccccgaccccttcttttaaaacagtttcttttaagttttcatttctgcgttcatcctccttcattcagtcccgtagtaaccgtggcaaaccacggcacttcaaaacctcataaaaagcaccacatattgcttatttggatacatatgttgtaaatgtgtgaaaacatgcatgggaatgacaaataccaaagtcaggatagtgactggccatggggaagggatggttattattgtcgtcttatatcttcaattccaaatgagccacgggcttaaaagtacttcattgaataaaaaaaaaccaacaatgta

SEQ ID NO: 10608 - DNA, 426 bp, Homo sapiens
tgcgccaaggtctcactctgttgcccaggctggagtgcaatggtgtaaccattgcactttgtagccttggcctcctgggctcaaggatcctcctgcctcacattccagagcagctgggattacaggcacatgccaccatgtccagttaattttttctattttttcgtagagttggggtttcaccatgttgcccaggctggtctcgaactcctaagctcaggcaatctacctgccttggcctcctaacgtgttacgattacagtgattaatatttcaaatagattatcctgaaaaaaaaaaaaaaagataaaacttaccttttaaggctatagtttcttttgactatttctctccttctccattcttgtttgtttgttttttgagacggagtctcgctctgttgcccagtctggagtgcagtggcac

SEQ ID NO: 10609 - DNA, 1991 bp, Homo sapiens
gtgcggtggagcgaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggttggcaaaagaaccattatcaataagctcttctttgatcttgcccaggaggaggagaatgtcttggatgcagaattcttaaagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaaaagcagatgaagtacttagagcagcagcaggatgagaccaaacaagcacaagaggaggcccgccggctcaggagcaagatgaagaccatggagcagattgagcttctactccagagccagcgccctgaggtggaggagatgatccgagacatgggtgtgggacagtcagcggtggaacagctggctgtgtactgtgtgtctctcaagaaagagtacgagaatctaaaagaggcacggaaggcctcaggggaggtggctgacaagctgaggaaggatttgttttcctccagaagcaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagaccgtgccttctctcttccaggccaagctggacaccttcctgtggtcgtgagaacagtgagtctgaccaatggccagacacatgcctgcaacttgtaggtcaaggactgtccaggcaggggttttgtggacagagccctactttcgggaccagcctgaggtgtaagggcagacaaacaggtgagggtgagtgtgacacccagagactgctcttcctgccctcaccctgccccactcctacgactgggagctgacatgaccagcccactgatcctgtcagcaggtcctgctcctgttgccaggctcttgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctagcatagcctgggccaagcagggtggggaatggaggatagacatgggatgtatggagaggatggaagattttcccg

SEQ ID NO: 10610 - DNA, 953 bp, Homo sapiens
gtgcggtggagcgaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggttggcaaaagaaccattatcaataagctcttctttgatcttgcccaggaggaggagaatgtcttggatgcagaattcttaaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctgtttcctttttctgttaagttgagc

SEQ ID NO: 10611 - DNA, 1972 bp, Homo sapiens
cccgggaaaaaattcccggatgggcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggttggcaaaagaaccattatcaataagctcttctttgatcttgcccaggaggaggagaatgtcttggatgcagaattcttaaagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaaaagcagatgaagtacttagagcagcagcaggatgagaccaaacaagcacaagaggaggcccgccggctcaggagcaagatgaagaccatggagcagattgagcttctactccagagccagcgccctgaggtggaggagatgatccgagacatgggtgtgggacagtcagcggtggaacagctggctgtgtactgtgtgtctctcaagaaagagtacgagaatctaaaagaggcacggaaggcctcaggggaggtggctgacaagctgaggaaggatttgttttcctccagaagcaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagaccgtgccttctctcttccaggccaagctggacaccttcctgtggtcgtgagaacagtgagtctgaccaatggccagacacatgcctgcaacttgtaggtcaaggactgtccaggcaggggttttgtggacagagccctactttcgggaccagcctgaggtgtaagggcagacaaacaggtgagggtgagtgtgacacccagagactgctcttcctgccctcaccctgccccactcctacgactgggagctgacatgaccagcccactgatcctgtcagcaggtcctgctcctgttgccaggctcttgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctagcatagcctgggccaagcagggtggggaatggaggatagacatgggatgtatggagaggatggaagattttcccg

SEQ ID NO: 10612 - DNA, 1924 bp, Homo sapiens
cccgggaaaaaattcccggatgggcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggaggaggagaatgtcttggatgcagaattcttaaagaatgaactggacaatgtcagagcccagctttcccagaaagacaaggagaaacgagacagccaggtcatcatcgacactctgcgggatacgctggaagaacgcaatgctactgtggtatctctgcagcaggccttgggcaaggccgagatgctgtgctccacactgaaaaagcagatgaagtacttagagcagcagcaggatgagaccaaacaagcacaagaggaggcccgccggctcaggagcaagatgaagaccatggagcagattgagcttctactccagagccagcgccctgaggtggaggagatgatccgagacatgggtgtgggacagtcagcggtggaacagctggctgtgtactgtgtgtctctcaagaaagagtacgagaatctaaaagaggcacggaaggcctcaggggaggtggctgacaagctgaggaaggatttgttttcctccagaagcaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagaccgtgccttctctcttccaggccaagctggacaccttcctgtggtcgtgagaacagtgagtctgaccaatggccagacacatgcctgcaacttgtaggtcaaggactgtccaggcaggggttttgtggacagagccctactttcgggaccagcctgaggtgtaagggcagacaaacaggtgagggtgagtgtgacacccagagactgctcttcctgccctcaccctgccccactcctacgactgggagctgacatgaccagcccactgatcctgtcagcaggtcctgctcctgttgccaggctcttgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctagcatagcctgggccaagcagggtggggaatggaggatagacatgggatgtatggagaggatggaagattttcccg

SEQ ID NO: 10613 - DNA, 2080 bp, Homo sapiens
gtgcggtggagcgaaatttgaagcaagcggaggcgcgggggcgcgtctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtgcctaattcagtggtttgagacagcaccaagtcggacctgcccacagtgccgaatccaggttggcaaaagaaccattatcaataagctcttctttgatcttgcccaggaggaggagaatgtcttggatgcagaattcttaaagaatgaactggacaatgtcagagcccagctttcccagaaagggatgaggcactgaatccaagggcccaagttcttctgctgatggatggacaggcctttccctttcctccgccctctacccctgctccagacaaggagaaacgagacagccaggtcatcatcgacactctgcgggatacgctggaagaacgcaatgctactgtggtatctctgcagcaggccttgggcaaggccgagatgctgtgctccacactgaaaaagcagatgaagtacttagagcagcagcaggatgagaccaaacaagcacaagaggaggcccgccggctcaggagcaagatgaagaccatggagcagattgagcttctactccagagccagcgccctgaggtggaggagatgatccgagacatgggtgtgggacagtcagcggtggaacagctggctgtgtactgtgtgtctctcaagaaagagtacgagaatctaaaagaggcacggaaggcctcaggggaggtggctgacaagctgaggaaggatttgttttcctccagaagcaagttgcagacagtctactctgaattggatcaggccaagttagaactgaagtcagcccagaaggacttacagagtgctgacaaggaaatcatgagcctgaaaaagaagctaacgatgctgcaggaaaccttgaacctgccaccagtggccagtgagactgtcgaccgcctggttttagagagcccagcccctgtggaggtgaatctgaagctccgccggccatccttccgtgatgatattgatctcaatgctacctttgatgtggatactcccccagcccggccctccagctcccagcatggttactacgaaaaactttgcctagagaagtcacactccccaattcaggatgtccccaagaagatatgcaaaggccccaggaaggagtcccagctctcactgggtggccagagctgtgcaggagagccagatgaggaactggttggtgccttccctatttttgtccggaatgccatcctaggccagaaacagcccaagaggcccaggtcagagtcctcttgcagcaaagatgtggtaaggacaggcttcgatgggctcggtggccggacaaaattcatccagcctactgacacagtcatgatccgcccattgcctgttaagcccaagaccaaggttaagcagagggtgagggtgaagaccgtgccttctctcttccaggccaagctggacaccttcctgtggtcgtgagaacagtgagtctgaccaatggccagacacatgcctgcaacttgtaggtcaaggactgtccaggcaggggttttgtggacagagccctactttcgggaccagcctgaggtgtaagggcagacaaacaggtgagggtgagtgtgacacccagagactgctcttcctgccctcaccctgccccactcctacgactgggagctgacatgaccagcccactgatcctgtcagcaggtcctgctcctgttgccaggctcttgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctagcatagcctgggccaagcagggtggggaatggaggatagacatgggatgtatggagaggatggaagattttcccg

SEQ ID NO: 10614 - DNA, 413 bp, Homo sapiens
gacaagatgtgtcctgctgagacccagagaaagacattgcagcaggtcctgccggatccctacaacccacggctgcgtccgggggttgctgcatttttcatcgtggaagattcttcctaagcaccctccctagacaggcacgcacgcggcgtggatgcacaggcttgcacctgctgctcacacccttgtcagccctggctactgtcaaacaggaactcttgggccgatgtcagcagcaaaaggaaccccacatctcattgtttcattttgtaatgtaaaattctctggtcaagaaactcttcagatgtttctggctatttttactgctctcctgtgaattgcctccttggagcctttgtccattttcctattgagagttgtttcaattaatttataacttttttgtttattaa

SEQ ID NO: 10615 - DNA, 400 bp, Homo sapiens
tttttttgggattttgggatgtttacatatccacaatgatgttatctcaggggacggaacccaagtctaaacaagaaaaccatttacgtttctgatacactttgtacacatagcctgagggtaattttctacaatattttaaagaattttgtgcatgtaacaaagctttgactacgttttgactgtgacgcatcaaatgaggtccggtgtgaaattttccacttgggtcttgtcggtgctcagaaaccttcagatttgaagcatttcagattttggattttccgatgagggaggctttcagaagggttgtggcaatatatgtcacaaggtggtgagggtctggaatagaataggagtgggtgggaatgtggtatatgaagaaagaagtagggcattgatg

SEQ ID NO: 10616 - DNA, 301 bp, Homo sapiens
aagcaacaactaaagggagaaatgcaatacccacttttcaataatagataaaactaccaggcagacgatcaacaaggaaatagaagacttaacactataaagcaactagaccttatagacacctagagaacattccacccaagaacatcagaatacatactcttcacaagtgcccgtaaaacattttcaaagataggccatgtattaggccataaaacaagccttataaaattaaaaggattgaaatcatacaaagtatgctctcccctcacaagggaattaaatgagaaattattaacag

SEQ ID NO: 10617 - DNA, 193 bp, Homo sapiens
cctgccgcggccccctctgtagcccgagctgctccgcgacgcgacggagccggcctcggacagagggagcggtcgcggcctcgcggcccgcgcgggctgacgagcggagagcgcgacgccgcgcggtccccgaggatccgcacgccgggcagcgcggcccgagcagcgcgagaagcagcgggcgggcgggcgg

SEQ ID NO: 10618 - DNA, 350 bp, Homo sapiens
gattctacaaaaagagtgtttcaaaagtgctcaatcataaaataggatcaaccctgtgagatgaatgtatgtatgacaaagaggtttctcagaatgcttctgtgtagtttttatgggaagatatttgattttccacagtaggcctcaaagttctccaaatatccacttgcagattatgcaaaaagagagattcaaaactgctcaatcaaaagataggttcaactctattagttgaaagaccacatcaccaagaagtttctcaggatgcttctttctagcagaatatgaagaaatcccgtttccaacgaaagcctcaaggatgtctgaatatctacttgcagacgtcgacg

SEQ ID NO: 10619 - DNA, 1484 bp, Homo sapiens
acccggaagcggcggagtagagcggagcctggcgggcgtgggaacccaggccccgccgaggcggccaggaggtgagatggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggattttgatgtgagaaatacaa

SEQ ID NO: 10620 - DNA, 2807 bp, Homo sapiens
tcattcccagccaggctcttcccaagcagtgctaaaggagagctaccttttccttccagttcagccccaagggaagggaaagtagtgcctctttcctattggctcaaccagagtcgcagcgttgattctcatgggtccaacttaagtcctataccccgccctgaactaatcactgcagaaatgtgaatggaatatgcagattggccaggtctggtacacaagcccgacctggaactagggagtgggacacaggcacatggattgagaagagggaggagggaagtccccaaaggtaagtcaggcttggggagagaatctgggtagatgcaaactacaggtgcccttcgaagtgaagacaggaggtttagtcttaggctgaggtcctccagaaatgctgggctcaagtctactcagaaggcaaggccaggatatgggtctggttggctttggggcatgggcaccatccagaatgaagatgtctcttgtccgcattggtaagagagacacacaggcctgagaaggaagcagagaagccccattgcaggatctgcctctgctccccctccactgtgaccttgggctctttctccaagaaggcagtggagggacagtcctcactgcaagcctggggcgggtgggactctgtacagagccaggagctcaaggggcttcctgtgagatggtgaactcctgtcccaagtatgccaaccagtggtggggacaactgaaccatgtgggacttgaggctactgtggtggggacagctgaaccacgtggggctgggtagttgtctccagggtggagggaggggggatgaactggatacctgactgtctgcatctccaggaggtgagatggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcagcactccttgctcaagacccctccccagtacctacccttccaggcccccctttcccatctcagggcagaggccacaggaggctgaagcgggttgggggatctgttcgtggcctcagagcggcgagagcccctcttcttcccgagcagtgggagtcgcgcttggtggaggccgaagacctgagacctctcgccctcctctgccctgctggccgcctacccagacggcttgtttgcccagggcacacgcccccttttctgtgcttcgaagtccctctcttttgccaaccctcatttggggcgtgagagcgggggttaggtggcacccactctgtcttagggtgctccctgtgacagatcctggtcttctttctgggttattgctgtttgtatcccaattttgcttcccagctgggtactctggggtaactgcaccctaggtcaggggatgggacgcggggcttcaccacgggcttcgcccctcctccggccgtttggagaacggccgagcttggggaccgcccggcgcctgaccgcccgcctccgcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggattttgatgtgagaaatacaa

SEQ ID NO: 10621 - DNA, 1504 bp, Homo sapiens
  misc_feature (29)..(29): n is a, c, g, or t
gaattatgctaagtagaggccggggtaantctggcgagggagctggagcctggctttctgtggaacccagtgcccgccgaggcggcaggaggtgagatggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggattttgatgtgagaaatacaa

SEQ ID NO: 10622 - DNA, 1955 bp, Homo sapiens
tcattcccagccaggctcttcccaagcagtgctaaaggagagctaccttttccttccagttcagccccaagggaagggaaagtagtgcctctttcctattggctcaaccagagtcgcagcgttgattctcatgggtccaacttaagtcctataccccgccctgaactaatcactgcagaaatgtgaatggaatatgcagattggccaggtctggtacacaagcccgacctggaactagggagtgggacacaggcacatggattgagaagagggaggagggaagtccccaaaggtaagtcaggcttggggagagaatctgggtagatgcaaactacaggtgcccttcgaagtgaagacaggaggtttagtcttaggctgaggtcctccagaaatgctgggctcaagtctactcagaaggcaaggccaggatatgggtctggttggctttggggcatgggcaccatccagaatgaagatgtctcttgtccgcattggtaagagagacacacaggcctgagaaggaagcagagaagccccattgcaggatctgcctctgctccccctccactgtgaccttgggctctttctccaagaaggcagtggagggacagtcctcactgcaagcctggggcgggtgggactctgtacagagccaggagctcaaggggcttcctgtgagatggtgaactcctgtcccaagtatgccaaccagtggtggggacaactgaaccatgtgggacttgaggctactgtggtggggacagctgaaccacgtggggctgggtagttgtctccagggtggagggaggggggatgaactggatacctgactgtctgcatctccaggaggtgagatggcagctgggcaaaatggcactcggtgccgctgcaactggagctgcgcgccggcgccgagcggctggacgctttgctggcggacgaggagcgctgtttgagttgcatcctagcccagcagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggattttgatgtgagaaatacaa

SEQ ID NO: 10623 - DNA, 2889 bp, Homo sapiens
tcattcccagccaggctcttcccaagcagtgctaaaggagagctaccttttccttccagttcagccccaagggaagggaaagtagtgcctctttcctattggctcaaccagagtcgcagcgttgattctcatgggtccaacttaagtcctataccccgccctgaactaatcactgcagaaatgtgaatggaatatgcagattggccaggtctggtacacaagcccgacctggaactagggagtgggacacaggcacatggattgagaagagggaggagggaagtccccaaaggtaagtcaggcttggggagagaatctgggtagatgcaaactacaggtgcccttcgaagtgaagacaggaggtttagtcttaggctgaggtcctccagaaatgctgggctcaagtctactcagaaggcaaggccaggatatgggtctggttggctttggggcatgggcaccatccagaatgaagatgtctcttgtccgcattggtaagagagacacacaggcctgagaaggaagcagagaagccccattgcaggatctgcctctgctccccctccactgtgaccttgggctctttctccaagaaggcagtggagggacagtcctcactgcaagcctggggcgggtgggactctgtacagagccaggagctcaaggggcttcctgtgagatggtgaactcctgtcccaagtatgccaaccagtggtggggacaactgaaccatgtgggacttgaggctactgtggtggggacagctgaaccacgtggggctgggtagttgtctccagggtggagggaggggggatgaactggatacctgactgtctgcatctccaggaggtgagatggcagctgggcaaaatgggcacgaagagtgggtgggcagcgcatacctgtttgtggagtcctcgctggacaaggtggtcctgtcggatgcctacgcgcacccccagcagaaggtggcagtgtacagggctctgcaggctgccttggcagcactccttgctcaagacccctccccagtacctacccttccaggcccccctttcccatctcagggcagaggccacaggaggctgaagcgggttgggggatctgttcgtggcctcagagcggcgagagcccctcttcttcccgagcagtgggagtcgcgcttggtggaggccgaagacctgagacctctcgccctcctctgccctgctggccgcctacccagacggcttgtttgcccagggcacacgcccccttttctgtgcttcgaagtccctctcttttgccaaccctcatttggggcgtgagagcgggggttaggtggcacccactctgtcttagggtgctccctgtgacagatcctggtcttctttctgggttattgctgtttgtatcccaattttgcttcccagctgggtactctggggtaactgcaccctaggtcaggggatgggacgcggggcttcaccacgggcttcgcccctcctccggccgtttggagaacggccgagcttggggaccgcccggcgcctgaccgcccgcctccgcagagagcggcgggagcccggacgtgctgcagatgctgaagatccaccgcagcgacccgcagctgatcgtgcagctgcgattctgcgggcggcagccctgtggccgcttcctccgcgcctaccgcgagggggcgctgcgcgccgcgctgcagaggagcctggcggccgcgctcgcccagcactcggtgccgctgcaactggagctgcgcgccggcgccgagcggctggacgctttgctggcggacgaggagcgctgtttgagttgcatcctagcccagcaggtgcggccgggctagggtcaggatggggtagggcggggatccgcggttaagtcccccgtgacggcacgttccattcccctagcccgaccggctccgggatgaagaactggctgagctggaggatgcgctgcgaaatctgaagtgcggctcgggggcccggggtggcgacggggaggtcgcttcggcccccttgcagcccccggtgccctctctgtcggaggtgaagccgccgccgccgccgccacctgcccagacttttctgttccagggtcagcctgtagtgaatcggccgctgagcctgaaggaccaacagacgttcgcgcgctctgtgggtctcaaatggcgcaaggtggggcgctcactgcagcgaggctgccgggcgctgcgggacccggcgctggactcgctggcctacgagtacgagcgcgagggactgtacgagcaggccttccagctgctgcggcgcttcgtgcaggccgagggccgccgcgccacgctgcagcgcctggtggaggcactcgaggagaacgagctcaccagcctggcagaggacttgctgggcctgaccgatcccaatggcggcctggcctagaccaggggtgcagccagcttttggagaacctggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggattttgatgtgagaaatacaa

SEQ ID NO: 10624 - DNA, 468 bp, Homo sapiens
ctactactactaaattcgcggccctcgactggatggccttagggttccttctgcggctattgctgaacccctgtccatccacgggaccctgaaactccacttggcctatctgctggacctgctggggcagagttgattgccttccccaggagccagaccactgggggtgcatcattggggattctgcctcaggtactttgatagagtgtggggtgggggggacctgctttggagatcagcctcaccttctcccatcccagaagcggggcttacagccagcccttacagtttcactcatgaagcaccttgatctttggtgtcctggacttcatcctgggtgctgcagatactgcagtgaagtaaaacaggaatcaatcttgcctgcccccagctcacactcagcgtgggaccccgaatgttaagcaatgataataaagtataacacggattttgatgtgagaaatacaa

SEQ ID NO: 10625 - DNA, 2631 bp, Homo sapiens
ttgcattgtcaggtaaattgcctttttttctgtgggacgtcatcaaaaaggcttgaaaaacactgctggaatcaatttatcctgttttctattcttctgaatgctaattttttttccttgagccattctactttcatttcaatcatgaaatatttccaactggccttgattaatgctttaacttttcaaagaaaaaacacccacacacatctcagtagaaaatatggtgaactgaagatgatatttggttttcaaaagaaaagtttggccaaatgttctgcattgcatttctgaggcacacacaggagcgggtgccagggtatttgactgtaggtaagtgaacaaggagctatacagatagaatggcacggggtttgacagtaatcagaacaccacatcagaacacttgattgcacttcaactctcatgctgtgtttgccccaaataatcttaaaaattgtgactatatcgaataagttcacaatacttattaggatgtggtgaaactgaattatttgaagtaggaagacccgaagttcttcgcctatgagactggtgaagtgatttgtagccaacatgctccaacccatctattaagaaaactatggcatctattaagaaaattcaaaatcttaaacagagaaatccatatttagaaaacatggccagattaaatagggggtgggttattttcttaaatacgttttgtcaatttcacgtgaaaaatgaaaacccctagttcatgttacatattacatttctgttaagatgtatgttcctctgtttctaatagaagttgtggtggtttggaagtgaaaattgaatgtgagcacaggccatgtaaaggaaggagaaagtgtaaatgttaataacaggaaaactgaatttagctctcatgaggcagtcaaggaaatcattcattgaacatgttgggaaatacttttcatttggtgaccaaatacctacaaattcatttacaaaaaagaaaaatgaaagttacctcagaactaaactcagaaatatgtcccacatgggttcttgtaatgtttcttggtgaatgtctttatagaaagaagtgggcatgaaatgatgactcagtaattaaacacatgggggaagggaggctgtagaaaacactggattctatatttaaaatttcattcagttcactaatttgtttttactgaccaaagctttctatacctatgtagagtgtctgagaactagaagggcccatcagttgccactcggatgatccttttgtctcttttcagataaggccccagttcaacagcgtcctctgtgtcaatcagatactcccaggaatgagtgagccctgccgttttcccaagttgcccctcagcacattccagccagttccaaaacttttggcttgtttttgacacaaggccagataagctactcaaactggtttttttaaaaaaagaaaacaaccccaatctatattccttttttaatactgtgtacataacctgctgctcgaaagactaggttttcccctttccagctagttgtgttgtttctttatgtagacagctttaaatcatgtttacatgattcagccattttaaacaacctcttcctatttttttttcctttttgtacaaaaaaaaaaaaaagaagaagaaagaaagcaactaactaaaacctttcctttcaaggatttatgcagcataggatagggcaaccacaagtaaacacaaacatcacgtgagccttcttaaagaaaacatttccagaaatcactccaatgtcttaaaaaacacacaaaataaaacctttctccactgcagtttaactgtggcaatgagttgcagacgatcaccaacactgaaacttaatttagcttttttctctcctctccaatcataaaaagtctctttttggttcttcatgcaggagctattttctttcttttctggcctctaacaggaaaacagagtttctagccgagctgctcctgaggtattaaaagtgatgttcgtgtcatgcggatcaatcctgcccaaacattagtgtgcatgcaaatcacctggcagtcttattaaatgcagaatctgattccatgaggtccatgttgtccgtggaccaaacttgcagtagtagcgaggagtctagaagacgtccatgttatagaaattgaacccaggaaaggatttggggcttatgaagctaacaaaagcacgtaaaacccagcctgagaaacagtagctacacccagctcttgttgctattctggaaccaaataatgcaaaatatgctcgagacacatctcagttcttgcttgcttgactttctgagtgtctctctggcacaagggcctgtcatttgaattcccatcccccacctcatccccatgtattattccactggatatcccaaatatctagagtttcaaaacccaaatgatcccatttggccagagccttttttatgagtatgctaatgttatctgtgtatgaagcacacaaacttttccaggatacccggctatctattaatccttcagcacggacgttctccatggtaacagtctgacctataagatctaatgcctttcccagggggctcagaatcccatgagtttgggttaaatctgccataacatct

SEQ ID NO: 10626 - DNA, 598 bp, Homo sapiens
ttttttttttttttaagatagccagtaacttggttttcttcccctaaggaaacattacgcacctcagagaaacaaggaaaaattttaaacagatactttgcaaaaataattacagttgactcttaattttctgtggtagaggaaagcagagatagcatgtgtgactgaaattcatggacatgccccaaatttcattttgaaaagcaatttcaacttctcatttaaacaaacctgttatttgctgcaaaattggttgatgtgagctttgcttcttttttcgagccagccagagggtaaagcagggaatgtataaaatagaagtaccctcaaacttgataatcaattcccaaggaaatgaaagttaaccataatcacttggcactgcataaagaaagaattctacaggaaatgtaaacacagctaaaaccgtctgatgtttactgttttcagagtctaaatgccctctttaaaaccaatatgtaagaaaagtcattagattttctttaccaagtctgtgattatttaaaaccaaatcatgaagctacagatttagaagtatctctaggaaatataaaaatgaagatatcacgcttaatct

SEQ ID NO: 10627 - DNA, 379 bp, Homo sapiens
tcaccttgagttttatagaaaattgatcatacatttgcctaagagccactaaagttgacaagcttcattttttattttttaatttttttagagaagatgatgaactagttttatgtccatgtgtaggggtgagtgcagtgatcacaagcatatctgtagggttaccacttatttgattctgtgcactgaaacatataacttgtatttgtacctttttttaatcagtatttgcacctttttatcagtatttgcagatactgattaccaacaccatgattgatgttcctaataagcaccttaagtcatttttctttcttcactaaagtattgatttatagaataaacatttcacttttatactgtttctcctcattcacta

SEQ ID NO: 10628 - DNA, 437 bp, Homo sapiens
atatcagagctagcttcacgcattcttttctcttgcctcccagctatcacgcagttgttggataaagcggccactgctcccaaagatttgatggaagttctgccagatttacccactcacctgaagggagattttctgtacaccccatgcccccggactggtcacaagggtcagctgagttggttcaccccctcccactctcgtcttcgaggcccttcatccaggaaaagtcagtcgcaaatttaaggcctggccctgtcgggtttcaaaacgatcccggaggacttgggccgagggacaaaggaaagcgaggtcagaggcggcctttcagcccgggagaggcctggggccgcacagccgccaccccctacatcacctccgccgtccccagtcacccccagaagtcccaaactagccagagcccgggcttgctcgcg

SEQ ID NO: 10629 - DNA, 817 bp, Homo sapiens
aggaaaggggcagcctacaaatcacagaacttttcgatggtaagtactttcctccagctaaatatcacaggaaaccctgcagcaccaccctcaccctgctaatcagagaacttttcggcggtaagtactttcctccagctaaatatcacaggaaaccctgcagcaccaccctcaccctgctaatcagaggctgagcaggtacttcagattcccactcatgacaagctgggatgagatgctcctctctgcagggttgctgtcagagaagactggctgaggagttggggttttacttctgctgggtggtgacagagcacagcctcctttctgctagggtatcataagagggaccttgcaaaactcaggaactttactgctgccctgtggtcatgaggccacccccctgtggtgtgggggagactgtatagggagcagcacggaggcagccctgattcagccttggtggtgggagtggaagttcggcaggaggctgaactttccttctcatgcaggggtccgtggaggctgagtgggaatctcaacttccacctcaccgtccacatccacctggcagaggcctgctctaacagaagacttacatcagatcctgagtctgatgtcaggatttcaatggaaaatcactcataggaaaatctcaacctcagtaagaaaagaccactgatgccaacgtagagatgacacagagtttagaattatttgacaaggaccttaaagcagcgattgtagaaatgcttcaataaccaattaacattcgagacaaacgacaaatagcctcaggaagaaaatacaggatgta

SEQ ID NO: 10630 - DNA, 294 bp, Homo sapiens
gaaaccagaaggccatcacttggttgtttgtttctacagtagaaatgaaaacaatttattgtttgctaaataatggacacactttaagaattttaaagtgattcgtaaccttcaagagtttacttggcatgtacagctgtttttaaaattgcattgaaatgctgttttcaaatatcctagagagaaggggtcttgtttttagtctgaagcaatatcagatcacatatatagtcagaaatatcataagtttgagtagaaatgtttatccttccttctacctaacttaaatgcctt

SEQ ID NO: 10631 - DNA, 379 bp, Homo sapiens
ctcaaatgtgtatacttatatccacaaatgtgtttaggtagaaaaacacttattctctactcctgtttgctgagaggccctgaaagcaatgaatccaaggtagcaatgataatacttagtgcccagaattggtttctaaataccattatcctcttaaaggaactagagctctttggagaaaaggctgactccagggctggagaaggaaaaatatgagatgagcctagaacatcttaagactggaaagttctcatggaatgacgggtcatgtcaaggggatacaggaggcagccaaggggccttccactggccaaagctgggacaactagagcaaaataagtaatgagtatatgggaacccatgaattcacactgctaca

SEQ ID NO: 10632 - DNA, 352 bp, Homo sapiens
cgcagacattgccctccccaacatccttctaatacaaattcttaagcattaagtcaggcggaaaatgagtctactctacatttatcttcctgaatggcagtcaactcccgcttaatctttcaacatatatttgttcaatggatcaacagattgtgtaagcagcatgacggttggatttagaaatgtgtctgctcatgtttggtttgtgctgaaccattgaccattttgtttgtgaatccatgataaattatatctctgcattacccagcactagggatgggacagaggacagtgctcacacaggcggaaagacttttttagtcactgtcattttccagcattgagaatgctg

SEQ ID NO: 10633 - DNA, 246 bp, Homo sapiens
tgacctgagccacatggagaggctgagtgactggggggaagtcactccctgagaggggcagcaatgaagagtggtgagagcaagatttgcaggcagcaggccgccagctctacccccaactccaccctgccagtggggctgtcctgggacacagctgcagcctttggtcccatgagccatttcaggattcttgccgtccttttcccttttgaagctggttccagttgagtttctatcactggaaac

SEQ ID NO: 10634 - DNA, 322 bp, Homo sapiens
tataaagcaggagtcagcaaaccatccctctctggccaatttcagccaattttgtgagtaaaattttattgtaacactggcatgtccatttgtttatgtgttgtctgtggcagctttatgtttataacagcagagttgagtagttacagcagtgtccttacggcttgcaaagcctaaaatactgactctctgtgccgctacagcaccctggtctgaagtaaacattttattataagattcaactgctctcatttttgtctttttcttcttttgatttttttttcaaatgcgtacctttctgtttttaatttgtgtgtctcca

SEQ ID NO: 10635 - DNA, 466 bp, Homo sapiens
aagatatactctgaacttactgcacttaaaaaataatgaaataatactttagaaaacaaagtaagtcatcaaatcatttatatgagaaaaatattccaactatccttggacttcttcacagcaatattcaattctcggaaacactggaagaacttcaaaatcctcaaaaaaaaaaagaatgtgacccatgaattttgtagacaggctgtcaaacataaaggcaacagtcacagagctattatatgcaatgaacttggggaatactgtttttataataagccttcttggagagtatattttagaaaaaagctttaatcatgagatgagtggttaaacagccaaagatgtaagaactaatggtagaattataactaaaaaataaaataaaataaaaaacagaggtagaacaaaacctaaatgccataagccctgacaatgtaaacatatattttacagaaattgaaag

SEQ ID NO: 10636 - DNA, 400 bp, Homo sapiens
tcagttgcccaggcgatctcggctcactgcaagctccgcctcccaggctaaccccattctcctgcctcagccttcggagtagctgggactacaggcgcccgccactacgcctagctaatttttttgtatttttagtacacacgggtttcactgtgttagcgaggatggtctcaatctgctgacctcgtgatccaccagtctcagcctcccaaagtgcttaatgtatttttattcagtgaaaagttttaaatgtcatgaatggaagttgaatctttctgaatgctcttttgagacctattaaaaggctcacaggaccccaggcccataatctgaattatattaattgtcttctactaatcaattcatatatatatccaattttgtcatataggttgataac

SEQ ID NO: 10637 - DNA, 371 bp, Homo sapiens
gatgtcctagcctctggaacttgtgaatgcaaccttagatggcagaactgattttgaagatgtgattaagttgaagatcatgaaaggggttaagtattctggattgtttgggtgggccctaaatgtaatcatgaggtccttataaaaaggacacaggagttgtcagagcgagagaaggcagtgtgaggactggaagcagaactggaaggttatgaccatgacccagggagacaagaaggggacaccccctgccatctccagaaggaaccagccctgtggacaccctgcctgtaaaccagtgaggttgattttggacttctggcctccagagctgtcagagaataaatttgtgttgttttaaatccctcagc

SEQ ID NO: 10638 - DNA, 315 bp, Homo sapiens
  misc_feature (206)..(206): n is a, c, g, or t
  misc_feature (241)..(241): n is a, c, g, or t
  misc_feature (298)..(298): n is a, c, g, or t
gagagtttttgatgaaacctgttgctttatataagccctaatgagttgtaattcagtactaaaatggttttcttgtgggctgggacttacaggatttggctgactatgcctctaagaatttagaagccatgaatcccccacttttcctccgctttcttaacctgctaatgaatgatgccatcttccttttggatgaagccatacangtatttgagcaagataaaagattcagcaaattganaaggatcgaggtgaatgggatagtctgactccagaagcccgccgagaaaaggagggntggcctacagatgtttg

SEQ ID NO: 10639 - DNA, 1158 bp, Homo sapiens
  misc_feature (1049)..(1049): n is a, c, g, or t
  misc_feature (1084)..(1084): n is a, c, g, or t
  misc_feature (1141)..(1141): n is a, c, g, or t
ctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacangtatttgagcaagataaaagattcagcaaattganaaggatcgaggtgaatgggatagtctgactccagaagcccgccgagaaaaggagggntggcctacagatgtttg

SEQ ID NO: 10640 - DNA, 244 bp, Homo sapiens
tttactttttctctccccttttcttcctatctcttccctcctttcttaacacgttcccctatccttccctcctttcaccactctctgcacttgatccccggtgtattccagcccccaggccaacacacttcaccgcgtccgcctggggcaggtcagagaagggacgcgaggcggcgctgtcacagcattctatgcgccccagcgccctgggccgcgcaggtcttttatcatttcagtggtcact

SEQ ID NO: 10641 - DNA, 235 bp, Homo sapiens
ggcttaacttgaaagctttttcattctaaaaatcttctcaagtctgagtgatgtggaatttgttctgtttatgtcacttcttgtctatggatgagccacggtgagggttttttcacaattatctctatttctgggcccctttggccttatcaagtaataacttttcttgattccagtcagtatcattctcctcaccagtctgatttcttgggatagtgtctcatacttccaagta

SEQ ID NO: 10642 - DNA, 304 bp, Homo sapiens
aaaccaacaaaaatcacacctaatggtgaaagattgaatgctttcctcctgtaaatgagaacaaggcagacttcctctacctccattcctatttgatgtcgtactgtaattcctagccagtgcaatcaggaaagaaaaagaaaggaatccagactggaaaagaagaaataaaactatccctgttcacagatgaaattactgtttacatgtgtccaaaaaacagacacactcgacacacacacacacacacacacacccctcctagaactaataaccgagtttagcaatgttgtagagtacaagt

SEQ ID NO: 10643 - DNA, 598 bp, Homo sapiens
ccgttcgtcagctgatggacacttgcgttgcttccacctttgggttcttgtgactaacgctgctatgaacgtgagtgtgcaaatatctgagtccttgtttttggttctttggggtatatacccagaagtggaattgctggatcatacagaaatttgatttttgattttttgaggaattagcagactgatcttcgtagcagctataccaccatcagagtactcaggttccaattgtctgttgacttttaaccagtccatcttgtcaatttatttaattttgccacaagttctggtaggtggcaggaaagcccatttgaaaattttgatgcagataaacagttcttttctgatatactcaggatcaaaggatcagaatcactttctgataaacttaccacttgtgtggcacagacacccagagttttagagtaagaatctgttgaacatactggtagggtttcattattttaataaccaacttcaccccattagctcagggctgcccacttccataaattctttgtcatgattctgaggagtgcttaaacagtgcttttcattctcttctgctgtcttataaatataaaaaagacttagc

SEQ ID NO: 10644 - DNA, 565 bp, Homo sapiens
cggcagctctgtgcagtaggtactattaatattatcacacccactttaaaatggaagaaaccaaggcaggaagtggtggggtcaggagctgaaccctgtaggtctgcctccgggcctgtgggtttattgtttcttgcaaatagcgaacagataacaagacaatcccaggccacggtgaatgtcatgcagacccaggctgggcgccatcactgcctgcactggtcactcccctgctgggcctccctgtcctctctgactagaggctcggtggtccctccttcctcatgggggctgcgggtgagctgagctgagctgagctgagctgtgggcagcccagcacgtgcaggagccggaagatgcctggccccctctctatggctcagtcttcaccgggtccccagggtggtgggcaggcacaggcactagctcagccctggcacctgcttgtacagggcaaggttggagtagctgccaagggtaagactcgcagcaaaggtggttgctggccccaggtgacccaggtggctggctgcccaaccctccgtcctaaagtgtcgatgctgga

SEQ ID NO: 10645 - DNA, 554 bp, Homo sapiens
tttcctgggtgaagtttacaagaaggctgcttaaatgcctgcttcggggaaatctctgcctctctctctctctgtctctctctctgtctctctctctgtctctctctctctctctctctctctctctctctcagtgtatttctctactttcttttacatttcctttttttctatccaaaaacaatgtgcttgttgaggcactggtaaccctgattaaccagaacctcccattcccagtatcgctgttcctacgcccatttcaccctcattaccttctgcttccaaggaatatgacagatcaccaggatgctgctcgtcgtgaggatttatctcaaaaaccaacatccaaaatgggagggagatgtggcttgaggtcaagcgccatgcatcccaagcctttgaccttcccgctatgggaagtgcactgggatgacagaaactgaatacattgctccctttccctaggggcaaagttcggacctctgttaagtgggagggatttgtgagataaaaattcaaaatgttgggcctgaggcctgagagtgtcaccaaag

SEQ ID NO: 10646 - DNA, 500 bp, Homo sapiens
aaggcatgattgtaactttgagatttaattttaataactagataagaaatataggagatttttattggctaaattctacgtcacacaggacaatgctggaaagaagcaggtattttaaaaattgtactccagtggcacatatagtcacgtctttactcttaagcctgtctgagaaacacttagagaaataacattcttgatattatgttggtccagtgaggatgagaaggtattttgacccaaacatatggatgcaggcttcaaggacacagcgaattataccatctgaagcaactggaaacgaaaagctgtgtggctgggaatcagcagtttgtaacaacagctggtgctgtgggcagcagtctaatggggaaatgtctcagcagcaagccttgcacacagacaaaacaaaatccacacctgtggttgtttacaaagggcagaaagggccatggaagacacatcattaatatggtggagagcaccattagcgattctag

SEQ ID NO: 10647 - DNA, 538 bp, Homo sapiens
tttaatttttattcaattcccaggacacagccccaggagatcctgagaacaaatgcaccatggatgcactttgaaaacatgctaagtgaaagaagccagacataatagactatggtttcatttacatgaaatgtccaaaatatagcaaaatccatagagacaggaagcagattagtgactgcttagggctagagaggaaggggaaatttaggagctagaggtttcttttgagggtgatgaaaatattctaaagttgaggcaatggttgcacaattctgtgcatgtactaaaagctactgaatttatactttaaatgaatgaatgaacgatactactatacaacatagtgctgtgcctatacttaactatactatattacatatttaaagttttctaagatagtagatcataataaaggggcagggtaaactctgggaggtgacagatacgttgatggccttgatgatggtgatggtttcacaggaatatatttatccccaaactcatagagctgtatacattaagtacagctttttat

SEQ ID NO: 10648 - DNA, 272 bp, Homo sapiens
gattactttgggtgttcaggaaggggaaagcttcatcatgcaggaagtgagatttgagttagttcttgcagattttgtgataataacaggcagaaatgggagagtggggtagtccatattgaaaaagcaagtgaacaaaagccttgggtcagggatgtcctggatgtattctgaaagtgagaataatgaagtatacattaaaaaaaatacaggctgggcacagtggctcatgcctgtaatcccagcactttgggaggctgaggtaggaggat

SEQ ID NO: 10649 - DNA, 439 bp, Homo sapiens
ttttttcaaaaaggcggactacctctactctgacttttgttgtttgtttttgagacagcagcttgctctgtcacacaggctggagcgcagtggtgcgatcatagctcactgtaaccttgaactcctggactcaagggatcttctcctctcagcctctcctggcctcaagtgatcctcccacctcagcctttcaaagtgttgggattacaggcgtgagcccactgtgcccagccaacttcgacatttttgaaaagtgaaacatataggtagatgtgatcttatctacatatggattttatatttaaccaaaaagtcaaggaataacttggctagtgatgttgtcaccattatcatcaaaattgccttcgttaaggcatttgcttctcttgactcatgtctagaaatgtctagaaagaatataaaaatagatgaaaaaaaa

SEQ ID NO: 10650 - DNA, 285 bp, Homo sapiens
ttaaatatcagtttatgttttattatgaagacaataaagtctcaaggttatgttcacttccaaaaaacaaaaaaggaaaaaggccatgcacaatgtctcacacctgtgagcccagcactttgggaagccaaggtgggagggtcgcttgagcccaggagttccagaccaacctgggcaacacagcaaaacctcatctctgcaaacaattaaaaaattagctgggtgtggtggtgtgcgcctgttgtcccaactacttgggaggctgaggaaggagaattgcttgag

SEQ ID NO: 10651 - DNA, 300 bp, Homo sapiens
ggtcccctcggggtgatggagatcatctgggtgtatggaactgtgtgtggttggccttactgggtggtcttccttcactgtctgcgggacagatggaggggcacagctgcccatggacccaggctctggggcttctggaaggtgccgaggagggcaggtgcgatgcctgggggcgttcagcaaatgcctggccctgccccctgtgccaacttggcctgggaggctcaggcacagctgtttcaagggtcctttatttcattcctggttcatttcaaagtgtctgtgtcttgttcggagcag

SEQ ID NO: 10652 - DNA, 329 bp, Homo sapiens
agaatataaattcctcaaaggcttttcctacaaataaaattaaacgcatctaatagttacctccattttaaagcccttctaatgataaaaacaatttgaatacaaaacaattttttatcttgacgttgtaaagttgctttaattgttttcatgtgttttgctttattttctaaaagagcctcaagattgatttactttctcccagatttcttacctctagtaaaatggttacggtagtttgggatgccatttcgcatgtaccgtgtgcctaaaaaggctgctaactatttggagtgggtatgtctaaaagtagttgggttgaatgaaaa

SEQ ID NO: 10653 - DNA, 332 bp, Homo sapiens
tagcaactctgtggggtagtttatggaagaggcagccaaacttcacacagctctgtgtgactagctagtaattgctagattcctgatctgcggcttctgggtcctatttcactactgtcatgatgcctactgtatgtatatcccactattcagaacagattcataaatagtgaaaatagaatgagctggagcatattaataaatatctattaaaatatttacttaataaataaatattggaattaatgaatttatgaaaaagggaactgtagcacaatggacccctttcccttcttatcactgtggccactggctatttgatatttattgaa

SEQ ID NO: 10654 - DNA, 326 bp, Homo sapiens
atctgtaatttaaactatctcaaaaccctatttttgaaatcaatcacttaatgtttttccttatgaccctcatgttgagataaaatgactaaatactttggttgactttaaatatcatttcttatttcttaaacaccctaccaataattaatctttcctataagaataacgttggcctgttggccgggcatcatggcagcaggtgcctatagtcccagctactcagaggctgaggcaggagaattgcttgacatggagattgcaatgagcccagatagcgccattgcactccagccttgtgcaacaggagtgaagctctgtctcaa

SEQ ID NO: 10655 - DNA, 404 bp, Homo sapiens
agcttgaccacagccatggggtcttcagcacgcttggctctttaagcttctcgtagagagcgtggaccatgtgcccaagggaccgagggtgttgtgagaggcaggcatgtcgcccacttcagccttgtttcctctgagttcctcttgccacctcccccgtgaccccctcgtacttaagtgctgttatcatgagatccatttttctggtttgacttctgtcgccatggcttattctaactggcaccgtgtacggagttccactttccatgactgaggaagtccagattttgtttgttttgagacagggtcttggtgtgtcactcaggctggagtgtagtgagccgagattgtgccactgcattccagcctaggtgacagagtaagaccctgtctcaaaaaagaaa

SEQ ID NO: 10656 - DNA, 349 bp, Homo sapiens
gtaatcaaaactctatgggactggcattaaaacagacacatagaccagaaacagaatagatagcccagaaataaacccaggtacatacagtctactactttttgaccatgtccccaagaacacaaaatggggaaaggatagtctcttaaacaaatggtgcttggaaaactggatatccacatgcaaaacaatgaaattggacacatacaaatacacaaaaatcaactcaaaatggattaaagacttatgtgtagaatgtgaaatcataaaatttctagaagaaaacataggggaaaagctccttgacattggtcttggcaataattcttttgataggacatcaaaagca

SEQ ID NO: 10657 - DNA, 246 bp, Homo sapiens
tgtttgctaacaatatttttgttgattctgtcgatcttttgctttatggcttctgggttattgttttacttagaaagttcttctgattccaatgcttttccaaatttgtgttatatttatgggatttttctctttacttttagctgttttatctagctgtagtttcccttttctgcaagacatgaagtatgggttgaaatttttctctcttccataatggatatctagcacacccaacattatgcg

SEQ ID NO: 10658 - DNA, 421 bp, Homo sapiens
gatataaatattaccatcttggaaatagtctctacaaagctgtgtactttctcacctgtgacgaaacagattttgaagtacttctgtccacaatttttatatgtctctgaatagagacagttagtggggtgcacgtgtgggagaagtcttataaaacttggggcattttcttttttaatatctagcccccctttcttcctcctccttaggaggtatgaatccttccctgcccctcatcccccaggcctgaagaacctttccccttccaaccctctcataactggctgccaccatttatgccttgcctgaagctcattcataccaacttgttgattccccctggtagctgcatttttagacttcttttcaatatctagcatgaaagtttgtatgttctgtaaaaggaatgtcatgtgactat

SEQ ID NO: 10659 - DNA, 424 bp, Homo sapiens
gcacccacaattactcaccgaggagctctctcagattccatggggctggaagggtcagtgtgataccgtgcacccacacttactcaccgaggagctctcggattccgtggggctggacgggtcagtgtgataccgtgcacccacacttactcaccgaggagctctcggattccgtggggctggaagggtcagtgtgataccgtgcacccacacttactcaccgaggagctcttggattctgtgttttcaagcctgcccatgtgtaggaaaagcacagcctccatgagaacagcaggaacacaccccccaacacgcacacccaaacacacacgcatgcacgtgcatgtgcacacacacacactcgtgcacgcacacgtgcacgcacacacacacagagcaacgtcctgcagctcccatcttttct

SEQ ID NO: 10660 - DNA, 504 bp, Homo sapiens
ctttttcttcctccctagaaatgaaaacattaaaaattcccacaaagggctcacaggtgactctactaagatgagtcgcatccgagaacaatggcaatggcagccaccatttactgagtgtttacatgggttgtttcacttaatctttatggaaacactgtgagatgggaactcttgttatatcttcaataagtgagcaaacccggaccagagaacctggtcactggcccagggctcacacttagtggtagagaagggtttgagccgactttggatcacagtccacactggaaacagctgtgccctgccgatgcttggcaggacagttcctgaccatctttcacatcaacaggaaatcgacccaactttactttcaggtgacagaaatccatctgtgcgctttcacctttgcagcactgagagatgttatttcggggtttttttgcacataattatcaagtgtaatttgaaaatcgttttttggttttttaatcccaaagatcc

SEQ ID NO: 10661 - DNA, 466 bp, Homo sapiens
gtttccttccgtgtcatgagctgcaaccttgtatcttaatgtgaaggtctgtgggaagctgaaacatgacttaggggaaatgaccttctcttagttgtgtctgggacagggagtctgacatcccatccctctccaatcaggactgcattcagtgtgcacataggtaaacaaaccaaaatagacctcacccaaaatagctccttccaagacaccctacagctctgtgtgaggccaggaaggctagtctggtttggatgctggctagggggccagcgctggtctggcatgcctcctaaggaagcaggagaagtacctgagactgttgtgtttgtgatccgacagcagttactgttccctttcctaagaaaccttggacagtctcagaggctcctttcttgtcctttgtgccagacacattcagctccctgtcctcagtagagattttagtttttctttccctttttaa

SEQ ID NO: 10662 - DNA, 372 bp, Homo sapiens
agatggagattgtgatcaagagctgttgactagaggtctatataagctaagaaaaattaaggctttaatggtagcatggatataaagggtagcaggaatttaggaaaagatgttcaagatggaaattaatctgaggtgttggttttcagggctagatttagagtttgaaaaccaggaggccagaggcaaagaaatctagtatctatgggcagggcaaggtcgaagacctggaaaattgaaatatgaggcagaaatgaaagtgtcattataagaaataagccacgcctggcatggtggctcacacctgtaatcccagcactttgggaggccaaggcaggcagatcacttgagcccaggagtttgagaccagtc

SEQ ID NO: 10663 - DNA, 509 bp, Homo sapiens
tacatttttataagtttccaaagaatttaggatttagtattaaagcacccctaactcaactttgtatacattactattaagcaatactacgaggccaaaaggatttcagaggatcttcttattctgtattatatcctgcagaattatgaagtttgtgtagttattattttgaaataaaatgatagtgaattacagaagaaagaggatttttcaggccaagcatggtggctcatgcctgtaatcccagcactttgggaggtcaaggcaggcggatcacttgaggtcaggagtttgagaccagcctgggcaacatagggagaccccatctaaactaaaaatacaaaaatgagctgggcatgttgacaggtgtctgtaatcccagcttcttgagagactgaggcacgagaatggcttgagcccgggaggtggaggttgtagtgagctgggatcctgtcactgcactccaacctaggtgacagggcaagactgtgtcccaaaccaaaaaaaaa

SEQ ID NO: 10664 - DNA, 436 bp, Homo sapiens
tacagggaacagaacattaaggggacccccaggttctggccatgttacgttttatggtactggttacatggacttgttctgtgaaaatttactgcattttgcacttctctgtatatgtattacacttcagtaaaagtttgccttaaaagaaaaagtaaagataacatgcaactattttctaaatggaaaatttccattcaatcaagttactgtttaaagtggggagggagtccccgatattttaacaaatggtcctaacatttagctactgcgtcttcactgaggtctgtggaggctgcaagtggtgtcacatccttagttctctgaatcatcgaaagcttctgtaaggcaattaattactcagacaaacatttccttcccaaaataaaacaaaaccaagatgtggtatttggtgttccaggggacacacacacac

SEQ ID NO: 10665 - DNA, 700 bp, Homo sapiens
ttcttttttttcagagacagggtctcactctgttgcccaggctggaatgcagtggcaccgggctacgtttattttgtagaaatggggtctcactaatattgcccaggctggtctcaagcaatcctcctgccttggcctcccaaagtgctgggattacaagtgtgtgccactgcacctggcccgctctgacttccgagtcttgagcaacacaaagccagggagacccccggtgggaccgtgagtcccagcacctccccatccctctgtctccctggaggctcattcctcacctttgtccatcccacagatacttctagagcacgtggtgcaggccaggccctaaggaaactgcagggaacgagggggaggctctgtctggactctggacttgctgggttgggttgtgttcctgaggcccctagggatccagctcggccatactctggctgggtgacctcaggtgggagctttaccacctgacacctcagcttctgtatctacagtggggacagtggacagcacggaagccttgctgtgcggatgaaaggagatggagggaaagagctgaacctgcctggtgaggtgtgagctttgggagcgctgagctccctgtgggatgatgggaatgacggggatgacggggatgatgggaatcatggggatgacgaggataatggggatgacagggcagccaccccgg

SEQ ID NO: 10666 - DNA, 396 bp, Homo sapiens
cattattctccaaacaatacagtctaataactatttacatcgcatttacacttactagatattgtaagtaattgagagatgatttaaagtacacgggagaatgtgcataggctatatgcaaatactataccactttaattttattatttatttatttttataacttcagcataccctgagaaaatactacatcattttatgtaggattctggtatctgagggaggtcctggaaccaatctcccacagataccaaggaatgactgtactttattaatacacaggggcttatttttgtggctttatcttctatcttgcattttactaacttcaattactatctgtagtaattttcagattgatttcttttgattttctaggtaattactgcacagtta

SEQ ID NO: 10667 - DNA, 3565 bp, Homo sapiens
ggggggtggggagccccacatctgagtagcctggatgtctcatgctggccctggcctcggtgaagcccttccggaaaggaagggggtgagaatcgggggaccccctttgcctttcaggcaaggccaagaattttctatctggagggacagacactctaaacaaattccccaagctgcattttcagatctattgaggagctttataagaacagagtagcccagccctctctgcatcaaacaatccagctcctgggcaggcagatggtgggagcctccccacgtgattctggcatgtggcagctgagagcggcacattgggcctccctgccaggcatgctaggctgtgggtttggacagccagaccctccctgggatcagaagggcgaggaacactgactctcccccactgggggctttgtcaccttgccttccccttaaccctgtgagggcacattgtcacccccattttgcagatgagtaaactgaggctcggagctgtcaggttctctgtcagggtcaccgagctgggaagcgagggtgcgggattcatgtaactggttggccacagacccctcccactgtcctcggctgctggaaatcacatccacctgccttcgatctcctgccctgcccccaactagccgtgccctctgagcccacacccaggggccctggtggcacatacgaagccactcacttctgttttgcatccgttaagtctgtagacatctgggaggagtcagcgatgcatcttgcccatgcatgtactcctagaacgccacccgggagcctggatactttaacgcaggttttccaggacccccacttctcacaggctgtcatgtgccccccagtcacctctgccacatctgctctggaaggctttctgggagtttctctggagcacagttgatgagaaccatggagactgaactagcggctcgagggtttcaccttggcacactcctgacagtctgactccatcttctcagccagatgggcctcctcaagacgaagctgtgccatgctgggcatggggcaaggagtgggacgctgctccgtgggccacctggcctctcaggggacctacagtgtagggagccacgaggcaaaatgtccggtccaggtcctggaggtttgttccaagtgctcagcctctgtctgtggtgtggaaactctcgggatgatggtgtggtgtttgcggcagagactggactgtgttcagggggagaggaaggcatgggggacagccctgcctcctacattcccgcagtgacagttttctcaggcactgggaagtcgccgcccctccctcactggccacatctagagtaggtcctgagtacctgtctccataatatccccagcacccagccatgacctccgcctggctcagccttcccccgctctcctgggcctgggcatccctcgcctcccccagatggccgcctgcctcatcgaacccccaatctgatctgcacattccaccaggccacccttctgaggcagctgcgagtccagctggacttgagtggcagagagcagctggggcggctgtgccctgccaggaggatgctgccccaagcctgccggctggcaggtctgagaaccatccggatcagtcctgtccaatagagacatgatgcaagccacagatgtcacttaaaatgtgccagtaggcacagtaaagaaagaaaaaaaggttaaattattttaaccatatgttttattaaacccagtgtaaatgattatcatttcaacctgcaattgatataaagcatttttaatgaactatttgatagtctagtaagtaaatgtttggaacccagtgtgtgtttacacgagggcacgtctcagtgtggaccagccacatgtcagtctcagcagcctggcgagaggccgccgtcactcagacttgaggggtcgcctggctgagtcgagcaagcccccagcctcagccacagagagaaacatacacttcctgcctttaccgttttgctgtatctgttgtgacctgtgctattgtttcttattatttttctttaaattaactcatgcattgaattttagtgaattcatttaaaagggaatctttaaatcagtactgtaagtgggaagccgggagcagaagtggaaggtaaccaccacattgccatgaaataaggcagcagcgataaactcccacccatggtctgtggcctgttgaggctctgagctgaggccgtgccctccctttgtaaagagaatggcagtggggagctggagagtgtgctggccccgagtctaagtcatctcctgcacctcgtaggtgcagctccccactgccagagacctcaggccaaagcccccaggacgcagctgactcagaacaggctgggtttacccctgttgaataacaggagaacgcataccccagggaccctggcaagctgcatgagaacgggtgagctagaatccattaccggatttggggctcagttgggtgctttgggtaattttgaggttctaaggaacctcaaaaagttggtgtgaccattaaatatgataacccctccaaacaactaactcagcaccagcacacagcaggggcatcacccacgccatctttttccatccctccctggctccccacaggccaggaggacttagaaggaagttgaggcctggtcctggcctgcctggctgggcaggagctacagatctcggccaccaggtgactggcagagaatggcctgcctggctcaccagcagcctctatccttcagggaaacttgtgacctttgagaaggctgcaggtccccagggccagcctagggccgtttctgggacacagccctaaatgcccacactgccaagtatgccaccagggactctgcctgaacccagggcccagatcttctggcttcactcgtctctgccactcaaccctggccatcctctaaagctggtagacaatgacagttctgtcacccattaaaatgaggccggcatcgagcaggagtgggaggagagagccccaggtgaattgtgaagagcacaggggacttttgatcattcgtgaatatttattcagagccttgtgcatgcttgcgtttttaacaccttctttttgggtgcatgagagtattttttgatggaaatctttattgagctcgttgtagattcacatgcagttgcaggagctcacaaagagggcccatgtacacttaacctggtttccccaatgacagcatatttcaaaactacaacacaatagcacaactggagtgtctgcaatgatgcaacccaccagtcctagtccgatttcccagttcacacgcactcatttccgtgtgcattttttgctacaatttttatcacgtgtaggttcaggcactcaacagcaccatcaagatgcaaaacagctctgtcccctcaaggcccctcctgccgccctgtgagagccacacccctctccctcctgcctgcctccccccatccttaacccctggccctctaatctgttctccatttctaaaactttgtcattttacaatgttatataaatagaatcacacagaatgtg

SEQ ID NO: 10668 - DNA, 551 bp, Homo sapiens
ataaggtaagaagtggtactgggttcttggggaaagtctccattgagaagaccatgtcatttttcctaacgttagtaaatttctcagatcctattccctcctccccccaactttctttttttttttttgcctcctttgagtctcttcttgcctcatttgcaccccccggcagctcaaacctacttgtttcaacaatgcttttatgaactaactggtcccccttacccttttgtcccttcccagcatccactcttgccaagcccaactctagattaatttgagtctccttacctcccattgccccccgctgggctggcaagcatttcctgaagaaagtcataaaaccaggctgagttgttcatgggagtggagagacgccgagatcatcgattgtacaaattgaaagaatcaggagatatcaagtcttatcaccatcctgaaagagaaatggagagttcgtttttagtagagctaaaaataagagcgaaaatttccttactcctgtattggtgttttccaacatagtgagttgagaagtagataaattgagg

SEQ ID NO: 10669 - DNA, 389 bp, Homo sapiens
gcctcttccctgcctccctgtcaccaagcagcctgctgggcaactcccctccttcttggctgcgacataactcagagtccaaagtttctgctgtctcaagcccttcagccaccaagacactcagcacagggatagggaaactggatcctggacataaggagatggcggaggagtcagagcttttgaagaataagatgcaagcccctcccctttcgaggtgtcctgagagccaaaaatgccagcaccagctgaggcttcatcactggaaacccagcgtccggcaccaggtgaaacgctgtagccccgctgtgctccgctcagccatgccacctgcagactgtcctgcagttctggaggccaccacagccacacgtgaagaaacagtgatg

SEQ ID NO: 10670 - DNA, 429 bp, Homo sapiens
cccagctacactaacttcttttcttttggctttaaaaaaaaaagtatgcatgttgctaatttcttatttctattatttaaaatttatataaatttgatctctggttttcgaaataatttgctaggtgttgtctcccctaaggtattggagagttgaaataatttaagatgagatgtcctttgttgaattgctttgtcttgtctccaagttttaggatcattcttaagggttataatttttataaaggctgacttatgaattacagaaaatacatatatagaaatacctaaattaaagttatacctataaaaccattatataactattatgtataaacagaaagtttagactcttaaatttgctctaaattacctatatcctagttttaagagtcctgtcaggatagtaaatgtttgctgacttttaaag

SEQ ID NO: 10671 - DNA, 417 bp, Homo sapiens
gttatacagttccaaagccacttacacactttcaggtatttgttgtagtaacaaccccacatcttggtaccaactttctgtcttagttcttttgttaaatgcctgagactgggtaatttataaagaaaataaatttaattcacagctgggcacagtggctcatgcctgtaatcccaccactttgggaggccaaggcaggcagatcacttgaggtcgggagttcgagagcaggctggccaacatggtgaaacccccatctctactaaaaatacaaaaaaaaaaaattagctgggcatggtggcacacacctgagtcctagttacccgggaggctgaggcaggagaatcgcttgagccggggaggtggaggttgcagtgagctgagatcatgttactgcactccagcctgggtgacaga

SEQ ID NO: 10672 - DNA, 368 bp, Homo sapiens
ctggtatcagcatatcacatgcatccccaaaatttgaacaactattatatatccatagtacttaaaaataaaaaattaaaaaatgtaatatactagacaatgagctttacaagtgttttgatactttcctcaggtttttcttctctttgagcatatggcttgagatagttgagaacatgagacatactagcacccatatttcttttgttctctttttaaacatgaactctagatatataatagttgttcaaattttaggggatgcatgtgatatgctgataccagcatacaacgtgtaatgattaaatcaaggtaattggggtactcctcacctccagcatttatcttttctatgtgttagagtcgac

SEQ ID NO: 10673 - DNA, 269 bp, Homo sapiens
ctgaattgagatgtgctataggtgtaaaatatgtaccaacttttattttgttttatttttgagataagatcttgctgcgttgtccagatgggagtgcagtcatgtgatctcagtttattgtagccttgagctcctgggcttgagggatcctcccacctagctacttgggaggcaaaagtgggaggatcagctgagccgggggaggtcgaggatgcagtgatgggccactgcactctagcctggctgacacagtgagaccctgtttggaa

SEQ ID NO: 10674 - DNA, 320 bp, Homo sapiens
tattgagtagatacattgaaacattggtatattctagtctagaaacataaagaggtcacaatttgggcatagttaagtactgagaaataagattggaatatagcctcaggagatattgaataccaggatgagaaatattgactcatatagttaattagtttgagtctgtaaatggtttgagtatgggaattatatgatcatggctataaaatgggaagactaatctgtcagcagaatatagattagactactggagtcaagagaaataaaaggtaaggaaactaggtcaactgtcattgcaagtctgagagtgtgtcaat

SEQ ID NO: 10675 - DNA, 400 bp, Homo sapiens
aatttcagactatggctaaacgtcctgaggcacggaggtttgccctgaaggttgaacttaaggaaaggtactaactgaaaatgaccaggagtttgcttaaatttagagaaagcttggatgagttcaaatgagaaatcatttcaggcatttttttctgttcctaaatagttctcctagcatgtgatagacaggctagaaaggacatatcctggtgtgtgagactggacatatcctgatgtcatatattgccacagagaactcagaaattccaagaagtttttgcatatgaacacttgccaacttatgtctcttgatatttcataaacatacaccaacttcattggctccaggaatccagaaattaaaaacaaatcctcaatgggaaattacactttcagga

SEQ ID NO: 10676 - DNA, 356 bp, Homo sapiens
agacagggtttcactctgtcacccaggctgcccaggctgtggcacagtcacagttcactgcagcatctacctcttgggctcaagtgatcctcgtgcctcagcctcccgagtagctgggactacagatgtgtgccaccacacctggctaatttttctactttttgtagagataaggtctcattatgttgcccaggctaggaatcccaacattcaacataaagctgtatttataaaaacataatttgtggccgggtgtggtggctcacaccttgtaatcccagcacttcgggaagccaaggcgagtggatcacccaaggtcaggagttcgagaccagcctggccaacatggtgaaacc

SEQ ID NO: 10677 - DNA, 538 bp, Homo sapiens
ggctcttgtgctgggaggtggccagtttcctggaaaggaatttatggagtctgaaagaggaattagtacaaattatattttcaaataagatacttgaaagttattgatgacagggaaaagattgtctaaagagggcttgaaattggggaaataattgaggctcagtgacaaaggagaagattacaacttcaaaaatgaataaataaataacattgcatgtttattttacaacaccagggggcgatgatgtctacgtttttattctgtatcctttatcgctgacaaagatttggtctctgcaattttaccttattgtttctcagatgaccaaggggttggcttaatttgttctgtttaaacttattgcaagtccttctgtaatttcctaatgttttcataatgtgtgttgtgaccagactctccttataaccccagttaataaaagttaacaggaaaaaaaaaaaatagaaggattggaagataaagttggggaaatttctctgaaagtaaaacaaaaagatagagatgaaaagtagga

SEQ ID NO: 10678 - DNA, 375 bp, Homo sapiens
taacatcttaaaagatcttaccactatgaaatcaatctctgtgaaatgataaaaccatacatcttttgtcaagtaatttattttttaccatttccatttgactatcaatttcaagaactctatttccatcagcgttctcgatggtgagcaacaaaaaccaactatgatgatttttacctgaaaaggaattcatcaaaggatattggggagctcatagaatctttgaggagactgaagaaccagattaagagtctatacagcctgaaacaatgcctaactgcaactcagggcttgtccagtgacaccaccacccaagctgccatgggacacacacatcaccccttgttccacgaagccctaatgctggactctgcc

SEQ ID NO: 10679 - DNA, 447 bp, Homo sapiens
ttttctgctgtctgtaacttatctatgccatggatgctagcatgacctgtatccataaaatgggcagtgggggtggagattccaattggcaggaattagtcatgctcacctgcactgtgccccttgactattgtctgccgctggatccctcagatccattttcctttctagagcttcagcctgaagcttggagttcagtttgggacaagcaacttccttaggaaggggcatggtttcattaagtccaggttgccctcaccagactgcagccagcagctgtgagggctacttctttgccatcttcttataagctgaatactcaggtatagctgtgcaacgggtttgtactcagacaatggagagaaagggagaattggggatctggcctagtaagatgccttccaaaagaaaacaaaacctcttgcatagaaaagctccctgtatgtg

SEQ ID NO: 10680 - DNA, 392 bp, Homo sapiens
tctttttttttctttaattgtgcagtggcgtggtcttggctcactgcaacctctgttacccgggttcaagcaatctcgtgcctcagcctcccaagtagctgggactacaggcgcgtgccaccacacccaactaacttttttgcatttttagtagagacggggtttcaccatgtcggccaggctggcctgaaactcctaacctcaagcgatctgcccaccatggcctcccaaagtgctgggattacagacatgagccactgcgcctaccctaggtctgcatttttcttacacagaagtatgttaaccctttctctcgcatattgtacagtacccctccccaactttctctcttttggttttttttttttttgagatggaatctcactctgtca

SEQ ID NO: 10681 - DNA, 144 bp, Homo sapiens
tttttgtctttaataaactgctggtatcatttcagaccacttgctatttaggcacttaggaatttttcactggaattcatgtaaagaaagaccatgggcgtttgtactggatttagtattcatcattcgactgcatgactcacc

SEQ ID NO: 10682 - DNA, 389 bp, Homo sapiens
attttatttctaaaaagaataagtcacatgtttgggcaactgtaatatattcacatgcaagttagtgatactatatgattctttgtttgcctctgacaatttgtagatgcaaacttggggttggtgtgtcttaaattttctgaagtttttagcattgtcaaatataatgaatggtacagttagtatcgacagaaaatgttagatagattataatacattataaaattaaatgtgcccgatgttttaataaatgccggttttacaagttacaagttatctaatgatctgtcatgtttttgctatccagacagttacagacaaagggataattaactacatataacccatttgcggaagtaatttctgttttaattaaagtaatgcaatta

SEQ ID NO: 10683 - DNA, 555 bp, Homo sapiens
cctcagcctcccaaagtgctgctgagattacagatgtgagccaccgtgcctggccacaaatggtatcgttttattttatatgcaatggttcgtttcaagtatattgaatacagttcccttctgcctgtttgtgttgtatcacaaaactcatattgaagctctaaaaccagagcatttgtaagccactcctggattttgaatggggcatggatggactcaacctcttttaattcctccaaagaatcccatgagatttaaaaaaaactttcactttagattcaaggggtacatgtgcaggtttgttatgtgggtatattgtgcagtgctaaggtttggggtatgaatgatccccagcacccagataggacccaatatgtaggttttcagcgcttgcccctctccctctcagcccctgcggttgtccccagtgtctattgttccatcttgatgtccatgtgtacccagtgcttggctcccacttgaagtgagaacgtggtatatggtggctcacgcctgtaatcccagcactttgggaagccgaggcgggcggatcac

SEQ ID NO: 10684 - DNA, 375 bp, Homo sapiens
ggacatggtgccatagtcacttacatattccttctgagggtatgttctgtgcatccccactgctggtaccaaatctgcctgccttcattggattagaaggagcagaaagccacttagactgccttagggaaacacaagattattacgcacctgttaaatatatttttctatttataactctcgctttttaaaagggtcctgtttggtggcttttcttctactaagcacagggtctggttaagcaaggggagctgaatgtctctgtatgataatacttggggagggatttggcctccacttgatatagaaggaaaaggagccaataggaggcaggtggccacatactatgatgtaacctcgcccccaagagccccc

SEQ ID NO: 10685 - DNA, 377 bp, Homo sapiens
tctgtataaaattccttcctgtttacatcaaacagcttggttttggaggttttctgaaactttcttaaaaactgaccatttgggctgggcacggtggctcatgcctgtaatcccagcattttgggaggccgaggcgggcggaccacctgaggtcaggagttcgagaccagcctggccaatgtggtgaaaccccatctctactaaaaatacaaaaattagctgagcatggtggcgggtgcctgtaatcccggctacttgggaggctgaggcaggagaattatttgaacccaggaggcagaggttgcaatgagccgagattgcaccattgcactccagcctgggagaaaagagtcaaactccatctcaaaacaaacaaa

SEQ ID NO: 10686 - DNA, 382 bp, Homo sapiens
ggctagagtccagccagggacaagctgtcccagtgggattagccttgactttaggagcatggccaggaagccaaagaagccttccaagaatggctgcctcagcccctgcactctggtcgcccatgttgggagaagagggaaaggctgagagaatggcagaagaggacctcaggggtcctgggagaatgcagacaagccttcctccagccagaatttctcttctcgggtccttatgggcaacagccttctgcaaagttgtcctaagacttcatctaagaagtggaagaggccgggtgcagtggctcatgcctgtaatcccagcactttgggaggctgaggcgggtggatcacctgaggtcaagagtttgagaccagcctggcc

SEQ ID NO: 10687 - DNA, 672 bp, Homo sapiens
ggttatgctgcatcaggtcctaagaaaacccaccttctgccagtagtaaaatccagtaagattggtattcttttggactatgaattgggtgattttttaaagtaatataaataataggtttgttctgtatattttaatgatctttcacaagagctgtttggccttatttctatgctgaagcagattctgaacgtcttaaaatctgttcattatcagatgctgaaagataaagagcaagtaaatgaatctatttcagttttgtgggtaatttagccagtaaatttaatcttatttcctttaatctttaagttttacctactgaaggcccagaatagatttttttctcttaaatttttggcaagtataaaagcacattcagaatgtcactttcatagatactatgaatatcaattgtcaagtgtgttgatttctaagataaaatatttgagaattaatattacccaacttgtccaataaaatgtttttaagttgcctattttttaaaaaatctatcaattttgaattgcatacctagctaaatttttttaagattgaggataatatgtaaaataatttatacaagtaatataaactaagtttacttaaattatttacttatttaagaaatctaattacattttaaataaattgctgttacctgttaaaaaaaaa

SEQ ID NO: 10688 - DNA, 374 bp, Homo sapiens
ggttctctgtctccccctgaacctttagccagaaatagagatgcaccctttcttcttcagtagctttgaggatcaaagaatcttagttgccagagctgggaggggaatctcaaagattgcctagtggaacaatatgattgttcatgtgaataaactgaaactcagagagaatgtggtctatgcaagacatggcccatagtctgtgtcaaaagccaggttttctgacttgtggcccagggctctctgtagtattctgggccagcaaaatcccgtgtctctccagacacatcttctcttgcaccaaatgggcctccttgctgtgtcctcctcaaaccaccctcactcccacctctgaacctttgctgatgttcaca

SEQ ID NO: 10689 - DNA, 364 bp, Homo sapiens
ccccatggcaatgtaaaatctcctctgccaagctggtttcaacttcctcccacttcacagctgttgggccttaaactctagccttaaacaagaaacacagcactgccgggaaaacccaggaaactggcacaggctccctgaactcagtgattcccctgctggttttcttctcatgccatatgggccagctgaggccagttcccacagtctgcaaggagactccacggttcttggacacgtgtgtcttggtccctgtggtgaagggaccacttccccagtgggagccatggagaccccctgctctctgtgtccatgggttactttggcagtggttccctagcactggctagggactggacattca

SEQ ID NO: 10690 - DNA, 307 bp, Homo sapiens
agtaataactgaaataaaatcaggaatgtgcaaaattgtttcttcatacctcactttctgaagacacttctttgcattctgctgcctggcatttacacagcagactcaggacaaagggacaaatggagtgagtgaggtgggcaggagctttagaagagatgaagcaaagagagttagttttttattcaggaagatgtagagactcttaaaggagaggcaatttccgtaacaaacacctctggtttaatggaagccacatgatttatttgactactggtcactcatttttaaaaagaaaagagaaaga

SEQ ID NO: 10691 - DNA, 468 bp, Homo sapiens
aattaactccctattgtctgctaacatcccattgtccaaatctagggacatcctgagcctgatatcaatggagtgaggggaaatggggaactgcacctgaactgggagggcagtgagtgatgtatggacactgaatgatgacatgattaggatcatgtaaaagactgtctggcaatatagcagcacaaagtaaatattcttgaacattaaattaatctgctaacaactgacaaacttacctaaagggagacattaaaaagaaaaatgggaaagacacaaataatgaataaattatttaaaaggagatctccctaagacccttcagccatataaaataagagtatattcagtagattgaggtgggagcattgcttgagcccaggagtttgaggctacagtgagctatcatctcacctgtgaatagcccctgcactccagcctgggcaatatagtgagacgttatctgtt

SEQ ID NO: 10692 - DNA, 211 bp, Homo sapiens
gctgggaaacagaccagaatcaggacatgtaaaacaaggccagggtgattaagtcacctctaaggtgtaaaatgaaagctacgccttaaaacaggagcaaatcagaaccaagaatctagttcttagccaatgcaaagtagagaacagaagcactaccacaccaattcaagtatcattgtttgatcagctacttgaaacaaaggaatacaaa

SEQ ID NO: 10693 - DNA, 426 bp, Homo sapiens
gctcatgcctataatcccagcactttgggaggccaaggcaggagggtcccttgaggccaggagtgcgagaccagcctgggcaacatatcgagacctcatctctacagacaaaaattaaccgggtatggtggtgcaagcctgtagtcctaggtgcttgggaagctgaggtgggagaatctcttgagcctgggagttcaaggctttgaagctgcagtgagctaggatcacaccactgcactccagcctgggcaacagagcaagaccccatctatttaaaaactagaatgtagataatcatatgcactttctctagagcctagagctgatctgacagtcacagaatcctgaactctgtacactttcttctacttagtagaagaaagagaagtgtactaactgcctcagtgggctctaggagcttgagtg

SEQ ID NO: 10694 - DNA, 335 bp, Homo sapiens
ttttagcaactctttaacagagttacccaatgctttttttaaaaaaataaagaaggccgggcgcggtggctcacgcctgtaatcccagcactttgggaggccgagacgggcggatcacgaggtcaggagattgagaccatcctggctgacacggtgaaaccccgtctctactaaaaatacaaaaattagccgggcatggtggcgcgcgcctgtagtcccagctactcgggaggctgaggcaggagaatggcgtgaacccgggaggcggagcttgcagtgagtcaagatcgcgccactgcgctccagcctgggcaacagagcgaaactccgtcaga

SEQ ID NO: 10695 - DNA, 6581 bp, Homo sapiens
tgcggctgttaaacatagagtcatttgctttgatagtcatctgacagtctcttttgaagtttgacaagcttttacatgacccaagcctaaagagaaagccatttctttcctctattcagaagtgaactgaatgagtgtgtgcaggttcaactaagatctcataaagaagtaatctggattctaccttaatacagactaatagatgatcaaagccttgcagttctattatatcacatagggtattgtcatatttgttttaatctggatgagaaatattttaaaaatgtgtatcactttgagattttttaaaaatctcagtaatatctagccctcacaatgtaattgaccaaccaaaggaaacatcttttgactgacaagtgactgtttagggaacaagaataagttgacttactatctgagattgtcaagcatttagacagttaaatgttagtgtacaagtaggaccagacatttgaaaactatgactttaatgttaaattcttgcatctctctgaaagcaattatataatatggccagtaattgattcaggtcattctaattttgtgacagtgtttctgtatttatatacagatacagatttattttatttttgaatgattgattgctagtcaaaagaattagcatccatgtgttgccctactaaaagtagcctttatgtttcatcaaacttgttccagctaatccatattttagaggcactatttggaggccgaagcattaatacccaggaagtatattttaatatggcaaagagaactcaaagcggtttgcttagtatcaagaatattagcaaagtgaattaggggaaaagaagttttaattttgttttgtttttcttacagctttgccgggaagtaaagctttggaggaaaatcaatatcaatgaacgtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaataggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaaatgggatgcaaaaagaaactgaatgatgttgaattttagtttttctttaagttgtggtaagcttttagtttagctgctttaacatgaagtcatacatacttagaggtaagtcatttattatttttttcctttttctaatcttttccttaaaattaatagataacaaactaagttacttttttactaacaaggaagatcaggaataatatttctttgaaagctgaaattatacttctcacagtttgctaccaaaaaaaggcttaaactaaaccttgacatccacagtagcatcaggaatagaaatgtatattttggctacagtttgcatacagtgaacacataaaatctatattgaaaactgacagaaatatgaatgtcgaggggcttggaattctaaatggaagattttagaaggaactttgctctctactgtcactatataaaaccaattatgttatgttattagatattaactctatttaagcttttcttttactaagaaattcttatgccaaatgtattccaagagccatctccttatgatgtatttgaaccatttagagaaattcacttcattgtaccccatgacctgaggtaaagaaaataattttcaaattgcagacttccttgaaaggctcaagactgtagcatggtgatgtctagattcatactttactgtaaggacagtttcggtagttaagtggaattaaaggtctagagtgatttgtattggatggtaactaaggtctatacatctactcttttaattcttatttccttcaggaagatccttttccacaggaagctatcaaagaaaagtaaactagacaccaagtaatatcactctcataatatgctttccagctagaggggagaaaacaccaggaaagaggaaccctgggtcataaaatgacggacctgttaggaaaatgctgttgtgtgacaatggagagcctgcccaaggactgtgcaacctatctgttcctctccaccagtgtatcccaagtagtctggtatgatctgtggttccttagaatattgaggatctctttaaaaaatgaaatttctgatctcaccccatattactaaagcaaaatttccaggggtagggactgggactccagaaccattaataaaacaaaacaaaacaaagcaaaatattgatgatcaggcagatttgaaaacagtgacattgcttgatctctgaatggatggatgcccttgggtggtcacttttcttcctaggacttgcctttgttatctgtaaattagaatggctatactttcagacttcacaattttaagccacttttttctattaacagttgaatgaaccagtgggacacattttaacgtcttcttatgttgactaaaattatagttagagctgagaaaaaaaaaatagcatctagtccaactccttgattgtaaaactgaaaaactaaggttatttgaatgttctgttttctctttttaaatattttataacttttaaatggaaaaacctattaggtaaatggaaataatccttgaaaatagtttttgatgttttgtgatttttaactggtaaatttctactttaggtgggcattttcttccctagaatatgccctttattatgctatcattgctagatttaaagggacttgtaagcatttctggaaatatttgatttaaaaacatatattaatagatgttttccctagcagacttttggagcaaaaatattattttagttcagcagaggattactgatattatgggctgatctcagaaaggaataaggatgaggcagagaggagtacttgagtttgtgtgtgtgtgtgtgtgtgtgtgtttgtgtcagtgtcacataagttctccatattgccttatgtcccaaagccaaatataaaaatataaatgatgctttgtataattcattttatcaaaaattacccataactttcatttgtttttatatcgacaatgaagatgatcatatttcattttgcagatgtggccataaaatattatttacttctacataggtgattttaccaggtttagttatcctgagaaaacatctggacttaagagtttctgcttccctacaaagatctttaaagttatttttaggcacatttgtgacaaacaactacttgatattgaaatctccttcagccattagaagctatcaaataaagtaggtgtaaaaacaactgtctgtggcatttgtatacatcgagaacatttttctttccctcattttctgcagtgaactccagtaaagctaagtgtcttatgaaatctaaactcatatatgtacacagttcactctagcttcttccaaaatatctctaggtagtacaactgaagccaaacctgcctgacttcctgctcctggccacccaaaactccatatggcttctcgtacactgacatcctctctctacccatttaactgctaattgagtctgataaaagtcttctttgaaaaaagtttttacttctaagatttgcatttacatcataaaattaaacgattttcaggaaaatcagattttttttattacagtactatttgctttaaattcggcatgtttttcttaagtagcaagtacatgtatcggaacttagaactggtgggcgcggtggctcttgcctgtaatcccagcactttgggaggccaaggtggggggatcacgaggtcaggagatggagacaatcctggtttcatcacggtgaaaccccctctctgctaaaaatacaaaaaattagccaggcattgtggtggtcacctgtagtcccagctgctcgggaggctgaggcaggagaatggcatgaacccgggaggcagagcttgcagtgagcagagatcgcgccactgcactccagcctgggtgacagagtgagactctgtctc

SEQ ID NO: 10696 - DNA, 792 bp, Homo sapiens
agtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcaggtacagttctgcctattgcgagccacggcggtggccaggctggcccgtggagccgcgtccctggggggcgtctcggcgcccggactgccgcgccccgcttgaggga

SEQ ID NO: 10697 - DNA, 6970 bp, Homo sapiens
agtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaacgtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaataggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaaatgggatgcaaaaagaaactgaatgatgttgaattttagtttttctttaagttgtggtaagcttttagtttagctgctttaacatgaagtcatacatacttagaggtaagtcatttattatttttttcctttttctaatcttttccttaaaattaatagataacaaactaagttacttttttactaacaaggaagatcaggaataatatttctttgaaagctgaaattatacttctcacagtttgctaccaaaaaaaggcttaaactaaaccttgacatccacagtagcatcaggaatagaaatgtatattttggctacagtttgcatacagtgaacacataaaatctatattgaaaactgacagaaatatgaatgtcgaggggcttggaattctaaatggaagattttagaaggaactttgctctctactgtcactatataaaaccaattatgttatgttattagatattaactctatttaagcttttcttttactaagaaattcttatgccaaatgtattccaagagccatctccttatgatgtatttgaaccatttagagaaattcacttcattgtaccccatgacctgaggtaaagaaaataattttcaaattgcagacttccttgaaaggctcaagactgtagcatggtgatgtctagattcatactttactgtaaggacagtttcggtagttaagtggaattaaaggtctagagtgatttgtattggatggtaactaaggtctatacatctactcttttaattcttatttccttcaggaagatccttttccacaggaagctatcaaagaaaagtaaactagacaccaagtaatatcactctcataatatgctttccagctagaggggagaaaacaccaggaaagaggaaccctgggtcataaaatgacggacctgttaggaaaatgctgttgtgtgacaatggagagcctgcccaaggactgtgcaacctatctgttcctctccaccagtgtatcccaagtagtctggtatgatctgtggttccttagaatattgaggatctctttaaaaaatgaaatttctgatctcaccccatattactaaagcaaaatttccaggggtagggactgggactccagaaccattaataaaacaaaacaaaacaaagcaaaatattgatgatcaggcagatttgaaaacagtgacattgcttgatctctgaatggatggatgcccttgggtggtcacttttcttcctaggacttgcctttgttatctgtaaattagaatggctatactttcagacttcacaattttaagccacttttttctattaacagttgaatgaaccagtgggacacattttaacgtcttcttatgttgactaaaattatagttagagctgagaaaaaaaaaatagcatctagtccaactccttgattgtaaaactgaaaaactaaggttatttgaatgttctgttttctctttttaaatattttataacttttaaatggaaaaacctattaggtaaatggaaataatccttgaaaatagtttttgatgttttgtgatttttaactggtaaatttctactttaggtgggcattttcttccctagaatatgccctttattatgctatcattgctagatttaaagggacttgtaagcatttctggaaatatttgatttaaaaacatatattaatagatgttttccctagcagacttttggagcaaaaatattattttagttcagcagaggattactgatattatgggctgatctcagaaaggaataaggatgaggcagagaggagtacttgagtttgtgtgtgtgtgtgtgtgtgtgtgtttgtgtcagtgtcacataagttctccatattgccttatgtcccaaagccaaatataaaaatataaatgatgctttgtataattcattttatcaaaaattacccataactttcatttgtttttatatcgacaatgaagatgatcatatttcattttgcagatgtggccataaaatattatttacttctacataggtgattttaccaggtttagttatcctgagaaaacatctggacttaagagtttctgcttccctacaaagatctttaaagttatttttaggcacatttgtgacaaacaactacttgatattgaaatctccttcagccattagaagctatcaaataaagtaggtgtaaaaacaactgtctgtggcatttgtatacatcgagaacatttttctttccctcattttctgcagtgaactccagtaaagctaagtgtcttatgaaatctaaactcatatatgtacacagttcactctagcttcttccaaaatatctctaggtagtacaactgaagccaaacctgcctgacttcctgctcctggccacccaaaactccatatggcttctcgtacactgacatcctctctctacccatttaactgctaattgagtctgataaaagtcttctttgaaaaaagtttttacttctaagatttgcatttacatcataaaattaaacgattttcaggaaaatcagattttttttattacagtactatttgctttaaattcggcatgtttttcttaagtagcaagtacatgtatcggaacttagaactggtgggcgcggtggctcttgcctgtaatcccagcactttgggaggccaaggtggggggatcacgaggtcaggagatggagacaatcctggtttcatcacggtgaaaccccctctctgctaaaaatacaaaaaattagccaggcattgtggtggtcacctgtagtcccagctgctcgggaggctgaggcaggagaatggcatgaacccgggaggcagagcttgcagtgagcagagatcgcgccactgcactccagcctgggtgacagagtgagactctgtctc

SEQ ID NO: 10698 - DNA, 6796 bp, Homo sapiens
agtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagacaagaagtaaaagaagtataatttctgtagtaaccaatgctataaaaacactgaagactgcttatttctttaaaaagatacaactcatcttaccaagaccaaattcaataagaagcccaaacactaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaacgtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaataggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaaatgggatgcaaaaagaaactgaatgatgttgaattttagtttttctttaagttgtggtaagcttttagtttagctgctttaacatgaagtcatacatacttagaggtaagtcatttattatttttttcctttttctaatcttttccttaaaattaatagataacaaactaagttacttttttactaacaaggaagatcaggaataatatttctttgaaagctgaaattatacttctcacagtttgctaccaaaaaaaggcttaaactaaaccttgacatccacagtagcatcaggaatagaaatgtatattttggctacagtttgcatacagtgaacacataaaatctatattgaaaactgacagaaatatgaatgtcgaggggcttggaattctaaatggaagattttagaaggaactttgctctctactgtcactatataaaaccaattatgttatgttattagatattaactctatttaagcttttcttttactaagaaattcttatgccaaatgtattccaagagccatctccttatgatgtatttgaaccatttagagaaattcacttcattgtaccccatgacctgaggtaaagaaaataattttcaaattgcagacttccttgaaaggctcaagactgtagcatggtgatgtctagattcatactttactgtaaggacagtttcggtagttaagtggaattaaaggtctagagtgatttgtattggatggtaactaaggtctatacatctactcttttaattcttatttccttcaggaagatccttttccacaggaagctatcaaagaaaagtaaactagacaccaagtaatatcactctcataatatgctttccagctagaggggagaaaacaccaggaaagaggaaccctgggtcataaaatgacggacctgttaggaaaatgctgttgtgtgacaatggagagcctgcccaaggactgtgcaacctatctgttcctctccaccagtgtatcccaagtagtctggtatgatctgtggttccttagaatattgaggatctctttaaaaaatgaaatttctgatctcaccccatattactaaagcaaaatttccaggggtagggactgggactccagaaccattaataaaacaaaacaaaacaaagcaaaatattgatgatcaggcagatttgaaaacagtgacattgcttgatctctgaatggatggatgcccttgggtggtcacttttcttcctaggacttgcctttgttatctgtaaattagaatggctatactttcagacttcacaattttaagccacttttttctattaacagttgaatgaaccagtgggacacattttaacgtcttcttatgttgactaaaattatagttagagctgagaaaaaaaaaatagcatctagtccaactccttgattgtaaaactgaaaaactaaggttatttgaatgttctgttttctctttttaaatattttataacttttaaatggaaaaacctattaggtaaatggaaataatccttgaaaatagtttttgatgttttgtgatttttaactggtaaatttctactttaggtgggcattttcttccctagaatatgccctttattatgctatcattgctagatttaaagggacttgtaagcatttctggaaatatttgatttaaaaacatatattaatagatgttttccctagcagacttttggagcaaaaatattattttagttcagcagaggattactgatattatgggctgatctcagaaaggaataaggatgaggcagagaggagtacttgagtttgtgtgtgtgtgtgtgtgtgtgtgtttgtgtcagtgtcacataagttctccatattgccttatgtcccaaagccaaatataaaaatataaatgatgctttgtataattcattttatcaaaaattacccataactttcatttgtttttatatcgacaatgaagatgatcatatttcattttgcagatgtggccataaaatattatttacttctacataggtgattttaccaggtttagttatcctgagaaaacatctggacttaagagtttctgcttccctacaaagatctttaaagttatttttaggcacatttgtgacaaacaactacttgatattgaaatctccttcagccattagaagctatcaaataaagtaggtgtaaaaacaactgtctgtggcatttgtatacatcgagaacatttttctttccctcattttctgcagtgaactccagtaaagctaagtgtcttatgaaatctaaactcatatatgtacacagttcactctagcttcttccaaaatatctctaggtagtacaactgaagccaaacctgcctgacttcctgctcctggccacccaaaactccatatggcttctcgtacactgacatcctctctctacccatttaactgctaattgagtctgataaaagtcttctttgaaaaaagtttttacttctaagatttgcatttacatcataaaattaaacgattttcaggaaaatcagattttttttattacagtactatttgctttaaattcggcatgtttttcttaagtagcaagtacatgtatcggaacttagaactggtgggcgcggtggctcttgcctgtaatcccagcactttgggaggccaaggtggggggatcacgaggtcaggagatggagacaatcctggtttcatcacggtgaaaccccctctctgctaaaaatacaaaaaattagccaggcattgtggtggtcacctgtagtcccagctgctcgggaggctgaggcaggagaatggcatgaacccgggaggcagagcttgcagtgagcagagatcgcgccactgcactccagcctgggtgacagagtgagactctgtctc

SEQ ID NO: 10699 - DNA, 6227 bp, Homo sapiens
gagcagctttttgacttgtaaaagtggtgaaggtttcaaagggacttgtcagtactgctctgtggaatggttggacttattttgcatccccttttcttgtaaagaatcgagattcaccgagctgagacttttctctttaagacagctagccatccactttcttccactgctaattgaccagtggtcgagcatccataggatttctccccagtgtgaaaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagaggcatcaactctagtgcttctctcaactgagttatcgctttgccgggaagtaaagctttggaggaaaatcaatatcaatgaacgtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaataggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaaatgggatgcaaaaagaaactgaatgatgttgaattttagtttttctttaagttgtggtaagcttttagtttagctgctttaacatgaagtcatacatacttagaggtaagtcatttattatttttttcctttttctaatcttttccttaaaattaatagataacaaactaagttacttttttactaacaaggaagatcaggaataatatttctttgaaagctgaaattatacttctcacagtttgctaccaaaaaaaggcttaaactaaaccttgacatccacagtagcatcaggaatagaaatgtatattttggctacagtttgcatacagtgaacacataaaatctatattgaaaactgacagaaatatgaatgtcgaggggcttggaattctaaatggaagattttagaaggaactttgctctctactgtcactatataaaaccaattatgttatgttattagatattaactctatttaagcttttcttttactaagaaattcttatgccaaatgtattccaagagccatctccttatgatgtatttgaaccatttagagaaattcacttcattgtaccccatgacctgaggtaaagaaaataattttcaaattgcagacttccttgaaaggctcaagactgtagcatggtgatgtctagattcatactttactgtaaggacagtttcggtagttaagtggaattaaaggtctagagtgatttgtattggatggtaactaaggtctatacatctactcttttaattcttatttccttcaggaagatccttttccacaggaagctatcaaagaaaagtaaactagacaccaagtaatatcactctcataatatgctttccagctagaggggagaaaacaccaggaaagaggaaccctgggtcataaaatgacggacctgttaggaaaatgctgttgtgtgacaatggagagcctgcccaaggactgtgcaacctatctgttcctctccaccagtgtatcccaagtagtctggtatgatctgtggttccttagaatattgaggatctctttaaaaaatgaaatttctgatctcaccccatattactaaagcaaaatttccaggggtagggactgggactccagaaccattaataaaacaaaacaaaacaaagcaaaatattgatgatcaggcagatttgaaaacagtgacattgcttgatctctgaatggatggatgcccttgggtggtcacttttcttcctaggacttgcctttgttatctgtaaattagaatggctatactttcagacttcacaattttaagccacttttttctattaacagttgaatgaaccagtgggacacattttaacgtcttcttatgttgactaaaattatagttagagctgagaaaaaaaaaatagcatctagtccaactccttgattgtaaaactgaaaaactaaggttatttgaatgttctgttttctctttttaaatattttataacttttaaatggaaaaacctattaggtaaatggaaataatccttgaaaatagtttttgatgttttgtgatttttaactggtaaatttctactttaggtgggcattttcttccctagaatatgccctttattatgctatcattgctagatttaaagggacttgtaagcatttctggaaatatttgatttaaaaacatatattaatagatgttttccctagcagacttttggagcaaaaatattattttagttcagcagaggattactgatattatgggctgatctcagaaaggaataaggatgaggcagagaggagtacttgagtttgtgtgtgtgtgtgtgtgtgtgtgtttgtgtcagtgtcacataagttctccatattgccttatgtcccaaagccaaatataaaaatataaatgatgctttgtataattcattttatcaaaaattacccataactttcatttgtttttatatcgacaatgaagatgatcatatttcattttgcagatgtggccataaaatattatttacttctacataggtgattttaccaggtttagttatcctgagaaaacatctggacttaagagtttctgcttccctacaaagatctttaaagttatttttaggcacatttgtgacaaacaactacttgatattgaaatctccttcagccattagaagctatcaaataaagtaggtgtaaaaacaactgtctgtggcatttgtatacatcgagaacatttttctttccctcattttctgcagtgaactccagtaaagctaagtgtcttatgaaatctaaactcatatatgtacacagttcactctagcttcttccaaaatatctctaggtagtacaactgaagccaaacctgcctgacttcctgctcctggccacccaaaactccatatggcttctcgtacactgacatcctctctctacccatttaactgctaattgagtctgataaaagtcttctttgaaaaaagtttttacttctaagatttgcatttacatcataaaattaaacgattttcaggaaaatcagattttttttattacagtactatttgctttaaattcggcatgtttttcttaagtagcaagtacatgtatcggaacttagaactggtgggcgcggtggctcttgcctgtaatcccagcactttgggaggccaaggtggggggatcacgaggtcaggagatggagacaatcctggtttcatcacggtgaaaccccctctctgctaaaaatacaaaaaattagccaggcattgtggtggtcacctgtagtcccagctgctcgggaggctgaggcaggagaatggcatgaacccgggaggcagagcttgcagtgagcagagatcgcgccactgcactccagcctgggtgacagagtgagactctgtctc

SEQ ID NO: 10700 - DNA, 6191 bp, Homo sapiens
gagcagctttttgacttgtaaaagtggtgaaggtttcaaagggacttgtcagtactgctctgtggaatggttggacttattttgcatccccttttcttgtaaagaatcgagattcaccgagctgagacttttctctttaagacagctagccatccactttcttccactgctaattgaccagtggtcgagcatccataggatttctccccagtgtgaaaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaacgtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaataggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaaatgggatgcaaaaagaaactgaatgatgttgaattttagtttttctttaagttgtggtaagcttttagtttagctgctttaacatgaagtcatacatacttagaggtaagtcatttattatttttttcctttttctaatcttttccttaaaattaatagataacaaactaagttacttttttactaacaaggaagatcaggaataatatttctttgaaagctgaaattatacttctcacagtttgctaccaaaaaaaggcttaaactaaaccttgacatccacagtagcatcaggaatagaaatgtatattttggctacagtttgcatacagtgaacacataaaatctatattgaaaactgacagaaatatgaatgtcgaggggcttggaattctaaatggaagattttagaaggaactttgctctctactgtcactatataaaaccaattatgttatgttattagatattaactctatttaagcttttcttttactaagaaattcttatgccaaatgtattccaagagccatctccttatgatgtatttgaaccatttagagaaattcacttcattgtaccccatgacctgaggtaaagaaaataattttcaaattgcagacttccttgaaaggctcaagactgtagcatggtgatgtctagattcatactttactgtaaggacagtttcggtagttaagtggaattaaaggtctagagtgatttgtattggatggtaactaaggtctatacatctactcttttaattcttatttccttcaggaagatccttttccacaggaagctatcaaagaaaagtaaactagacaccaagtaatatcactctcataatatgctttccagctagaggggagaaaacaccaggaaagaggaaccctgggtcataaaatgacggacctgttaggaaaatgctgttgtgtgacaatggagagcctgcccaaggactgtgcaacctatctgttcctctccaccagtgtatcccaagtagtctggtatgatctgtggttccttagaatattgaggatctctttaaaaaatgaaatttctgatctcaccccatattactaaagcaaaatttccaggggtagggactgggactccagaaccattaataaaacaaaacaaaacaaagcaaaatattgatgatcaggcagatttgaaaacagtgacattgcttgatctctgaatggatggatgcccttgggtggtcacttttcttcctaggacttgcctttgttatctgtaaattagaatggctatactttcagacttcacaattttaagccacttttttctattaacagttgaatgaaccagtgggacacattttaacgtcttcttatgttgactaaaattatagttagagctgagaaaaaaaaaatagcatctagtccaactccttgattgtaaaactgaaaaactaaggttatttgaatgttctgttttctctttttaaatattttataacttttaaatggaaaaacctattaggtaaatggaaataatccttgaaaatagtttttgatgttttgtgatttttaactggtaaatttctactttaggtgggcattttcttccctagaatatgccctttattatgctatcattgctagatttaaagggacttgtaagcatttctggaaatatttgatttaaaaacatatattaatagatgttttccctagcagacttttggagcaaaaatattattttagttcagcagaggattactgatattatgggctgatctcagaaaggaataaggatgaggcagagaggagtacttgagtttgtgtgtgtgtgtgtgtgtgtgtgtttgtgtcagtgtcacataagttctccatattgccttatgtcccaaagccaaatataaaaatataaatgatgctttgtataattcattttatcaaaaattacccataactttcatttgtttttatatcgacaatgaagatgatcatatttcattttgcagatgtggccataaaatattatttacttctacataggtgattttaccaggtttagttatcctgagaaaacatctggacttaagagtttctgcttccctacaaagatctttaaagttatttttaggcacatttgtgacaaacaactacttgatattgaaatctccttcagccattagaagctatcaaataaagtaggtgtaaaaacaactgtctgtggcatttgtatacatcgagaacatttttctttccctcattttctgcagtgaactccagtaaagctaagtgtcttatgaaatctaaactcatatatgtacacagttcactctagcttcttccaaaatatctctaggtagtacaactgaagccaaacctgcctgacttcctgctcctggccacccaaaactccatatggcttctcgtacactgacatcctctctctacccatttaactgctaattgagtctgataaaagtcttctttgaaaaaagtttttacttctaagatttgcatttacatcataaaattaaacgattttcaggaaaatcagattttttttattacagtactatttgctttaaattcggcatgtttttcttaagtagcaagtacatgtatcggaacttagaactggtgggcgcggtggctcttgcctgtaatcccagcactttgggaggccaaggtggggggatcacgaggtcaggagatggagacaatcctggtttcatcacggtgaaaccccctctctgctaaaaatacaaaaaattagccaggcattgtggtggtcacctgtagtcccagctgctcgggaggctgaggcaggagaatggcatgaacccgggaggcagagcttgcagtgagcagagatcgcgccactgcactccagcctgggtgacagagtgagactctgtctc

SEQ ID NO: 10701 - DNA, 6506 bp, Homo sapiens
agtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaacgtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaataggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaatatgcagtactgtttatattttgtataccttttaataggtatccacttaaggcatttgcagtacaaatattaattgaccacttccttggcccccagctacaatgaaaaagaagaattatgcacacatctaacattggtagatttctaaagacaactcataaataatttcttaacccatataaggataaaataataccattgatattcttgtttattctttttaaataaaaatgtcacaagtttaatagatcagccttgtaaagcaagcataaaatgttcataaatgttttatatattatttggtagtctagtatggctttaactgaatatttgatcctcagagacagtatcatgagactgcattataaatgacatgattaaatgatgaatttattttgtcagcctcagcaacaaacatttcctaaatgggatgcaaaaagaaactgaatgatgttgaattttagtttttctttaagttgtggtaagcttttagtttagctgctttaacatgaagtcatacatacttagaggtaagtcatttattatttttttcctttttctaatcttttccttaaaattaatagataacaaactaagttacttttttactaacaaggaagatcaggaataatatttctttgaaagctgaaattatacttctcacagtttgctaccaaaaaaaggcttaaactaaaccttgacatccacagtagcatcaggaatagaaatgtatattttggctacagtttgcatacagtgaacacataaaatctatattgaaaactgacagaaatatgaatgtcgaggggcttggaattctaaatggaagattttagaaggaactttgctctctactgtcactatataaaaccaattatgttatgttattagatattaactctatttaagcttttcttttactaagaaattcttatgccaaatgtattccaagagccatctccttatgatgtatttgaaccatttagagaaattcacttcattgtaccccatgacctgaggtaaagaaaataattttcaaattgcagacttccttgaaaggctcaagactgtagcatggtgatgtctagattcatactttactgtaaggacagtttcggtagttaagtggaattaaaggtctagagtgatttgtattggatggtaactaaggtctatacatctactcttttaattcttatttccttcaggaagatccttttccacaggaagctatcaaagaaaagtaaactagacaccaagtaatatcactctcataatatgctttccagctagaggggagaaaacaccaggaaagaggaaccctgggtcataaaatgacggacctgttaggaaaatgctgttgtgtgacaatggagagcctgcccaaggactgtgcaacctatctgttcctctccaccagtgtatcccaagtagtctggtatgatctgtggttccttagaatattgaggatctctttaaaaaatgaaatttctgatctcaccccatattactaaagcaaaatttccaggggtagggactgggactccagaaccattaataaaacaaaacaaaacaaagcaaaatattgatgatcaggcagatttgaaaacagtgacattgcttgatctctgaatggatggatgcccttgggtggtcacttttcttcctaggacttgcctttgttatctgtaaattagaatggctatactttcagacttcacaattttaagccacttttttctattaacagttgaatgaaccagtgggacacattttaacgtcttcttatgttgactaaaattatagttagagctgagaaaaaaaaaatagcatctagtccaactccttgattgtaaaactgaaaaactaaggttatttgaatgttctgttttctctttttaaatattttataacttttaaatggaaaaacctattaggtaaatggaaataatccttgaaaatagtttttgatgttttgtgatttttaactggtaaatttctactttaggtgggcattttcttccctagaatatgccctttattatgctatcattgctagatttaaagggacttgtaagcatttctggaaatatttgatttaaaaacatatattaatagatgttttccctagcagacttttggagcaaaaatattattttagttcagcagaggattactgatattatgggctgatctcagaaaggaataaggatgaggcagagaggagtacttgagtttgtgtgtgtgtgtgtgtgtgtgtgtttgtgtcagtgtcacataagttctccatattgccttatgtcccaaagccaaatataaaaatataaatgatgctttgtataattcattttatcaaaaattacccataactttcatttgtttttatatcgacaatgaagatgatcatatttcattttgcagatgtggccataaaatattatttacttctacataggtgattttaccaggtttagttatcctgagaaaacatctggacttaagagtttctgcttccctacaaagatctttaaagttatttttaggcacatttgtgacaaacaactacttgatattgaaatctccttcagccattagaagctatcaaataaagtaggtgtaaaaacaactgtctgtggcatttgtatacatcgagaacatttttctttccctcattttctgcagtgaactccagtaaagctaagtgtcttatgaaatctaaactcatatatgtacacagttcactctagcttcttccaaaatatctctaggtagtacaactgaagccaaacctgcctgacttcctgctcctggccacccaaaactccatatggcttctcgtacactgacatcctctctctacccatttaactgctaattgagtctgataaaagtcttctttgaaaaaagtttttacttctaagatttgcatttacatcataaaattaaacgattttcaggaaaatcagattttttttattacagtactatttgctttaaattcggcatgtttttcttaagtagcaagtacatgtatcggaacttagaactggtgggcgcggtggctcttgcctgtaatcccagcactttgggaggccaaggtggggggatcacgaggtcaggagatggagacaatcctggtttcatcacggtgaaaccccctctctgctaaaaatacaaaaaattagccaggcattgtggtggtcacctgtagtcccagctgctcgggaggctgaggcaggagaatggcatgaacccgggaggcagagcttgcagtgagcagagatcgcgccactgcactccagcctgggtgacagagtgagactctgtctc

SEQ ID NO: 10702 - DNA, 3687 bp, Homo sapiens
  misc_feature (3647)..(3647): n is a, c, g, or t
  misc_feature (3681)..(3681): n is a, c, g, or t
  misc_feature (3687)..(3687): n is a, c, g, or t
agtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaacgtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaataggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggtagcatatcacaaagtaacgatgtgtccggtatttggaaaaccaatgcccacatgcctgtgcccatggaaaatgtgcctgataatcccaccaagaaatccacaacaggcctagtaagacaaatgcagggacacctaagtcctcgcagttatcgaaatatgctccacgagcatgactggagaccgagtaatttgtctggccgtccgaggtcagctgatcccaggtcaaattatggtgttgtggaaaagctgctgaaaacctatgagacagcaacagagtctgcattgcaaaattctaagtgcttccaggataattggaccaaatgtaattctgatgtcagtggtggtgccacattaagtcagcatttagaaatgctccaaatggaacaacagtttcagcaaaagacagctgtgtgggggggacaggaagtgaagcaaggaatagatccgaaaaagataacagaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaataaaaanctggcctcgttggcctcagcggtggagctctgcngccggn

SEQ ID NO: 10703 - DNA, 3223 bp, Homo sapiens
  misc_feature (3183)..(3183): n is a, c, g, or t
  misc_feature (3217)..(3217): n is a, c, g, or t
  misc_feature (3223)..(3223): n is a, c, g, or t
agtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaacgtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggatgaagtcagattcttttctccaggaaatgccaaatgtaactaatatacctcatggggaccccatgatcaacaatgaccagtgcattcttccaatcagtttagaaaaagaaaaacagaaaaataggaagaatctgagctgtaccaatgtgctccagagcaattctacgaaaaaatgtggaattgatacaatcgatttaaaaagaaatgaaactccaccagttcctcctccaagaagcacctctcgaaattttcccagctcggattctgaacaagcctatgaaagatggaaggaaaggttagaccacaacagctgggtgccccatgagggtcgaagtaaaaggaattacaaccctcacttccctttgagacaacaagagatgtctatgttgtatccaaatgaagggaaaacttcgaaagatggtatcatcttttcctctttggtaccagaagtcaaaatagatagcaagcctccaagtaatgaagatgttggacttagcatgtggtcatgtgacattgggataggtgcaaaaaggagcccctctacttcgtggtttcagaaaacctgctctacccccagtaatccaaaatatgaaatggtgatcccagatcaccctgctaaatctcatcctgatcttcatgtaagtaatgactgtagctcctcagtagcagagagcagtagcccacttagaaatttcagttgtggctttgaaaggactacaaggaatgagaagctggcagcaaagactgatgaatttaacagaactgtatttagaacagatagaaattgtcaggcaatacagcaaaatcacagctgctcaaaatcatcggaggatctcaagccctgtgatacctcatctactcacacaggaatccatgtcagtgaacgcctcacatggaaaaggattttcccgacctgctagaccagcaaatcgtcgtctcccctccagatgggcatccagatctccatctgcaccccctgccttgcggagaactacccacaactataccatttctctgcgatccgaagcattgatggtttaagtctttggcctggattgctatattacagaagttctagtcccacttgtcaaacagagcattctgagtgtttacaggcggacctgttctcttccgacaagcaatttgaatcttaactttccatcagtcttcagtgtttttaatctaaggaataattatcttcctgcattttgatttcttagatcagaattttttaatgccatcctcattagttttccaatacaatataagttgaaacaatgtacaatattgtatattctttgttgcaagtggcagaaagtaaggttatgtgcatggccatgtgtttgtaggtgcatgtgttgaaataggaagtatcctagtatgtatttagatatgaaaaacttatgtgctagtgttgactttgaaattataacatgtatacctatatattctttgtgtttatttaaaagttttgaaaataaaaanctggcctcgttggcctcagcggtggagctctgcngccggn

SEQ ID NO: 10704 - DNA, 2088 bp, Homo sapiens
agtccggcggccacgacagcgcgcggcaccacgacaacgccaagaccgaggccctgcaggaggagctgaaggcggcgcgcctgcagatcaacgagctcagcggcaaggtcatgcagctgcagtacgagaaccgcgtgcttatgtccaacatgcagcgctacgacctggcctcgcacctgggcatccgcggcagcccccgcgacagcgacgccgagagcgacgcgggcaagaaggagagcgacgacgactcgcggcctccgcaccgcaagcgcgaagggcccatcggcggcgagagcgactcggaggaggtgcgcaacatccgctgcctcacgcccactcgctccttctacccggcgcccgggccctggcccaagagcttctccgatcggcagcagatgaaggacatccgctcggaggccgagcgcctgggcaagaccatcgaccggctcatcgccgacacgagcaccatcatcaccgaggcgcgcatctacgtggccaacggggacctgttcggactcatggacgaggaggacgacggcagccgcatccgggagcacgagctgctctaccgcatcaacgctcagatgaaggccttccgcaaggagctgcagaccttcatcgaccgcctcgaggtgcccaagtctgcggacgaccgcggcgccgaggagcccatttccgtgagtcagatgttccagcctatcattttacttattctcattcttgtattattttcatcactttcttacacaacaatatttaaacttgtcttcctttttacactgttttttgtactgtaaatctttcatcatttaccattcattgtagtattttcagtttgtttattttgttcacccttcaagacaagaagtaaaagaagtataatttctgtagtaaccaatgctataaaaacactgaagactgcttatttctttaaaaagatacaactcatcttaccaagaccaaattcaataagaagcccaaacactaaaatatttcaggctttattttaaaggcaagtgagactgcttcaaataaaacaacttcaagcttccaagaaacagttaagaggaggcagagaagagcagaaacacttctttgctgacacttacactgttgccatggacctacataagcagtgggagaacacagagactaactggcataaggaaaagatggaattactggaccagtttgacaatgaaagaaaggaatgggaaagtcaatggaagattatgcagaagaaaatagaagagctttgccgggaagtaaagctttggaggaaaatcaatatcaatgaacgtgctaagatcattgatctttaccatgagaagaccattccagagaaagtgatagaatcttccccaaattaccccgatttaggacaaagtgaatttataaggacgaatcacaaagatggtctgagaaaagaaaataaaagagagcagagcttagtcagtggaggaaatcaaatgtgtaaggaacaaaaagcaacaaaaaaatcaaaagtagggtttttggatcctttggctacagacaaccaaaaggaatgtgaggcctggcctgacctgaggacttctgaggaagacagcaagagctgttctggcgccctcagtacagctcttgaagaacttgcgaaggtgagtgaagaattatgcagctttcaagaggaaattcgaaagcggtctaaccatagaaggtaggttggtacatctgattattttagatgggtaaataaaaaataatattgtttttagttaatgactccaaactgcctcctccttacatgtaagaactaatgagttattaaaatgtactatctagggtgggagatagaaactttaattttttgtttgctcgtttgtttttgagatgttatcttgctctgtctccaaggctggaaagcagtggcatgatcttggctcactgcagcctctgcctcccaggttcaagcgattctcctacctcagtctcccagctgctcgggaggctgaggcaggagaatggcatgaacccgggaggcagagcttgcagtgagcagagatcgcgccactgcactccagcctgggtgacagagtgagactctgtctc

SEQ ID NO: 10705 - DNA, 2180 bp, Homo sapiens
ctcaaagccccctattagtaacattctggttcactgaggtttgatcatattcctatctgcattccttcccttctttgaaggacagctgatctttcagaagcagaataaaattaagatgttagaacaaaggtctcagtctcagagaaccgcatcacttcatttgctcagacccatcctcttttgcaaaagggtctgcttggagaggccaaaattcagggtgctctcaaaggcaaagaaagcacattgttttccttctccagtccaactttcatcttttcttctgctgttttcttttcccctcttctttttcacaaatgttcaaaatggtctcatgcgcatgtgtcttgccccactttcccctttagctgaacagaaaattttgtctcagtaaaacgaagtcaaaaaacaggattcctccaaacatgcctcctcccgcactggccagccgagtccagctgagaaacttatgctagattcaatgtcattgagcaatgctttattgaagtctcgttcttctcacttctgcaccagtgagccaatgatactgacagaaatgtcatctctcttctatctgtggttgctgtttttggagtaaaagtttctgtgtgtgtttttttagttcttttgatggctgttgttttgcattgtaaataccatgatgggggacccccatcagaacatggcttatttaataatttatttcgtatttattgagtaatattgggaaaagagaaggaccacctctttccctgaattgctattgagaattggtccatctcccagctccaggtgctgctgtctgcagcaagggcattactgcccaggtaaggagtgctagaatcaccaagcaaattgaaattggcagaaatggaggcttcagtcacacaaattagactcaaatggaactaaaacactggttatctccaggaaaacctcatttagatggaaattaatggaagaataaaatgcctacacatgaaccaacttctattaaaaagtcacaactccttgaaaaaaaaaataaagaaaaattgtaaaactcttttttttttctggccaaggaaagctatgcctcatcttctaacgagccaagccaaaaagactgcaatggtattcctatgtgtttctttggcctgtgtatcagtctgaatgaaatggaatgggtctctagcctcagtcttgtcatctgtaaaatggggcttgtcctatatattatctgcaagacgtgggaaatgggggctcaagccctgatgctatggactccatactgttggatatattgtctcttgtgtcttctgctgactgcagattaaagggtgtcaaccaaggaaggaaacaaaaaagtagggcctggacttcatttgcagaatgaggtcatagtcgttgagtcccacagtcatatatgggagacctcaagttgctgtcaccttgataactcttgtatcctgggttaaagccctctgtatttagtttgaacttctctctaagccccgtggtccaaagtcatcacgggagagaccaagatgggcttaccttgccctgctctggatttaaccattgttcattgtcaggctatatttttgtacaatcattcaaataacccagtgacataggtcatattgccacttttcagaggagaaaactgaggctcaggagggggagttgacatgcccaagctcccttgagctcagatcagcttgactcaatgtccaacattcccttggtagctttttctccggggtcctgtgctataagaacttctctctgcactgtatttttttttctcccaattcttagctatttcctcaagcaatgattggccaaggacctagcataatccaccacattggccaaggggacgtggtgcaccccaaggccatttctctgcattggaggctgcgaatctcctctggaaaattcccaacccgaggacccaccatgagcccagctcagcctgaccagacagcctctgcctggagcattcacatcagatggaaagaagctgctgtgtcctccagcatcctgggaccctgtcctctgcccagtgacacagcagccatggctagcttgatttctggtctccaaagctaagcataaccttcccggggtttctggtttttcagcctgtacgaaacatgtctctgttctaattaaagttcccatggtatggtgttctcaaa

SEQ ID NO: 10706 - DNA, 392 bp, Homo sapiens
ttttttcttttgtaggtaattcacatgtcagtaatacaaatgtttagcaaaaatagagtggaagcattgtaaaatcacccaaagaagttatgctttggtttatgcatctttaacaatagtatttgacatcaaaacactctttatctataaatttaataaataattttttagtgataaaacttaaggatcgcaagtatatcaaaagccgaaaaccactttaatttacggctggtaagtatgcaactagcaacaactgtttgagactaatttggcaatataaatctagggtcttaaaatgtaaatttctcaagcccaataattccgctttggtcaatcttaccccaggaaataatctggtcttctggagggaattttaggtaccaagtagttca

SEQ ID NO: 10707 - DNA, 659 bp, Homo sapiens
tgcctgacacataaccatgcctttcacagtattcattcattcattcattcattcatttactcactcatttgacaacactgattgagcacctgttacatgccaggcactgtcctgagagctcaggagatacaccagtgaacacaaaagaagtgactgtttgtagaatatggatgcaggattgtaatgtgcctcaaatgaaattatggttgtgaaagtgatacgctgacctgactcagtgcctcacacctgtaatcccagcactatgggaggccaaggtgggaggatcgcttgagccaggagttcaagaccagcctgggcaacacagtaagacttgtctctataaaaaagtaaaaaaaaaaaaaaaaaaagtgaaacacaaaccaagagaatgtgttcactttacatttgcatggcactttacagtttacatagtgagttcacatactcattcacttattctttcattcattcagtaagcatttctcgaatacctactatatgctgggcacaatgcatatggtttctgcttctgaagacttacttctgaggctagtgaggggacagagacaggtcccccaacagttggaaatgcctgtgggacttccagatgaggatgtagaggtctagagatgatctagcgccactgcttagggcaggcg

SEQ ID NO: 10708 - DNA, 437 bp, Homo sapiens
agttatctgggcactgacttttctcattcataataaaagatgtggggaggacacagagaggggagtttcaactacatgacctatacgatccctccagaatctgattctaaagacctgtgacaatgcaattcattgggaaatacgcatggtatcactacaggtttacctgttgctaatgcatgagtgagacaaggacaatgacaaagtcagtgaacagtccttctgtttagtggtctagtggtgttttctacagggaaagtcacatggggcctttcgtagggagcttctacctagtctattgagacaactccattgaagcaatgggcttcacccatgtaacccgaatttttcaaagctcaattcagcaaatgcttctaccttgatcaaagcctctgtgttcacaaggctgttattttacatcagggttccaaactcaa

SEQ ID NO: 10709 - DNA, 1828 bp, Homo sapiens
tgggtgtgagatcagttagggggctcgttcagttctctaggtgaggactgtcctggtggcttgtcctggatggtggctggggaagtggatgcctgaatgccaggctctggagaagagatgactccctgccccatccccctgcctaccctcctcctcaatggcccctctctcagtggatgtgagtgaggattaggaccttccccacagagccaccttttggccaggcctcgtgggggatagtgggggcagtgctgagttctaggagtgttcctggaagttgggggcagtgagtgctcagcctggcccaggtgggagagttcactgctgcccaggccttagcaggagctgctgtgctgtctttctgtcccatgctgagcattgtgataggaagctgccacacagtgccctggaaactgacttggcatgctttccatggggcttccgagggccagggactgggctgggggtggcctagcagctctagtggagactgtgctgccgcagggctgaaggaagaccaaccaaggggacagccgtttgagcccagcccactcactgcctgctgcacctccagctggagcccagggttgggcagctctcatactcttatctaactgccagacctagagggagggaagcccaaggctgcaggtctgagggacacggctcatgggcaaaagggtatcaagaggattagagtcacttgcataggaaaagagggtcagagaggctgagggctggctgaggccagagaggttccctgaccttggacattctttgtgttgtgtaagacctcggcatctttagagaaaggttcttgtgcccctgtgagcttgctcagctgctatggccacttgaaccccaaaaatggtggcctagaagagaatacaccccttacttcccacttatcctcctctcaacctaggaaagatcagacatattgactcaacagtctaacaggggatgggctggatctgcccgtgaccagaccaatgccccccacccagcaagggagtaaacgctgcctgaagtgggaccagtgatacacagcatctctgtctgccagggctcagcccgcgggggggatttgtgagaggctgagcagctgggtctgcacagacagcaagctgcactttgatttcatttgattcccttacaaaatgacattaaggggaatgtgaggcacaggagactcgcctgtctgggaaggcagcaagctcatctctcctggacctggtgacctacctctgtctaccagacaggtgcagaggacaggagctctggccacaaagaaatggacagtctgaatgcagcacacagccctggggacaggacttttcacccagcctgtcctgacaagctgctgagtcgagcagatgctcacatcagggtcccaggtccggctgttagggaagtggacatcagttcctggtgggccctgggcagtgactgtggtgagccacagcaccattgctgctctgcctctcaaatcgatcgaacaattaatttggctccacaggctcgagaagatgaaacatgacctgatggccactgctgtccagcatcccagtccatcctagctgtccaggatgatgaacaagctatggaaattgcacttgagagctataatcacgggaagcattgccgagcccctccctgctacataaatcatgctaagaagcacacaatggcctctttcctgatgggctaattgtcttggtttggtgtctcaggcccaggagctgggaagatgggagcacaaccatttattgttggaaagaccatctgtgcaacttgaatacaaagtgattcttttagttccccacac

SEQ ID NO: 10710 - DNA, 1404 bp, Homo sapiens
tgggtgtgagatcagttagggggctcgttcagttctctaggtgaggactgtcctggtggcttgtcctggatggtggctggggaagtggatgcctgaatgccaggctctggagaagagatgactccctgccccatccccctgcctaccctcctcctcaatggcccctctctcagtggatgtgagtgaggattaggaccttccccacagagccaccttttggccaggcctcgtgggggatagtgggggcagtgctgagttctaggagtgttcctggaagttgggggcagtgagtgctcagcctggcccaggtgggagagttcactgctgcccaggccttagcaggagctgctgtgctgtctttctgtcccatgctgagcattgtgataggaagctgccacacagtgccctggaaactgacttggcatgctttccatggggcttccgagggccagggactgggctgggggtggcctagcagctctagtggagactgtgctgccgcagggctgaaggaagaccaaccaaggggacagccgtttgagcccagcccactcactgcctgctgcacctccagctggagcccagggttgggcagctctcatactcttatctaactgccagacctagagggagggaagcccaaggctgcaggtctgagggacacggctcatgggcaaaagggtatcaagaggattagagtcacttgcataggaaaagagggtcagagaggctgagggctggctgaggccagagaggttccctgaccttggacattctttgtgttgtgtaagacctcggcatctttagagaaaggttcttgtgcccctgtgagcttgctcagctgctatggccacttgaaccccaaaaatggtggcctagaagagaatacaccccttacttcccacttatcctcctctcaacctaggaaagatcagacatattgactcaacagtctaacaggggatgggctggatctgcccgtgaccagaccaatgccccccacccagcaagggagtaaacgctgcctgaagtgggaccagtgatacacagcatctctgtctgccagggctcagcccgcgggggggatttgtgagaggctgagcagctgggtctgcacagacagcaagctgcactttgatttcatttgattcccttacaaaatgacattaaggggaatgtgaggcacaggagactcgcctgtctgggaaggcagcaagctcatctctcctggacctggtgacctacctctgtctaccagacaggtgcagaggacaggagctctggccacaaagaaatggacagtctgaatgcagcacacagccctggggtctgggatctccaccgtcttctgctcctcagtcaggccggccccccagccctggccggccccccagcccggtccgg

SEQ ID NO: 10711 - DNA, 351 bp, Homo sapiens
cctctgggtctgcacctgcttgctctgtttgtgttgcatgtcttactgttcttttctggctaaccctaaattattcttcagaattcaccacagtgatcgcttcctcctggaaggctttctcctgtcccacactcgattgggttgccctctgggtgccctcacagccgcctctgcttccctctatgggatcacattccacactggtatccagttgtgtgtttattttgctgggtaccccacagctccgtgagcctctgaagcatgggttctatcctgattgtcatggcatccccagcacatagcacccccagcacatggcacataggaggtgtcaataagtatgacataatg

SEQ ID NO: 10712 - DNA, 852 bp, Homo sapiens
ggtttgaaatcggaaagttggcggggctgcgggagctgagcctagagtccggctgttggctagagtgggcgcggatctggtgtggggaaggcggcgggactcaggcctgcctgcgaagcattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaacatacaaatagtgtatataaaaacggtttatttttcttctctatt

SEQ ID NO: 10713 - DNA, 302 bp, Homo sapiens
aaggcctttgtacatcgatctgcctttgaatttcctggcacctgcctacctgcattctgacttcctctgggatccacatgtggacctgtggcgcaacctcttgcttggccagggtgagcagggcatcagcattccaaagctaagagaataagatacacacacacacgcacacacacacacacacacacacatctccaaaactcagacaggaacatttatttttattttgttaagtcaatgcagttttcatctagaaatatagcaagagctctaccatttttttatttgaacaattgcttaaa

SEQ ID NO: 10714 - DNA, 1340 bp, Homo sapiens
ggtttgaaatcggaaagttggcggggctgcgggagctgagcctagagtccggctgttggctagagtgggcgcggatctggtgtggggaaggcggcgggactcaggcctgcctgcgaagcattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaacatacaaatagtgtatataaaaacggtttatttttcttctctattacatatctctttttttcttgtttttattattattatactttaagttttagggtacatgtgcacaatgtgcaggtttgttacatatgtatacatgtgccatattggtgtgctgcacccattaactcgtcatttcattaggtatatctcctaatgctatccctcccccctcccccaacccacaacagtccccgttgtgtgatgttccccttcctgtgtccatgtgttctcattgttcaattcccacctaggagtgagaatatgtggtgtttggttttttgtcctttcgatagtttgctgagaatgatggtttccagcttcatccatgttcctacaaaggacatgaactcatccttttttatggctgcatagtattccatggtgtatatgtgccacattttcttaatccagtctatcattgttggacatttgggttggttccaagtctttgctattgtgaatagtgcgaaataaacatacgtgtgcatgtg

SEQ ID NO: 10715 - DNA, 1128 bp, Homo sapiens
cggggcggggcggggcgggtggaagatagtgcccatcttctattagcagcaggatgtatgagcacagatgacaatccggtccatgctgttcatcagacaaagcctgaatcctggaaaaagccaactctttgaacaggaattagagtgtgatcggctcagttgacgtacaggggtagaaacctttatttgaagccgataaatgacttgtcgtgggcgagcccttcgggtgctattaatactttcgggtcacagcggagactctggctgttgttcagaaaagaactacgaatcccagaatgccctgttcccccattttcccctcgagaatccaaggcattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcgtactgtgctaaatgccttacattgaccacctccttcagtcctcatgatagttctccaggagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaacatacaaatagtgtatataaaaacggtttatttttcttctctatt

SEQ ID NO: 10716 - DNA, 808 bp, Homo sapiens
ggtttgaaatcggaaagttggcggggctgcgggagctgagcctagagtccggctgttggctagagtgggcgcggatctggtgtggggaaggcggcgggactcaggcctgcctgcgaagcattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatgcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaacatacaaatagtgtatataaaaacggtttatttttcttctctatt

SEQ ID NO: 10717 - DNA, 797 bp, Homo sapiens
ggtttgaaatcggaaagttggcggggctgcgggagctgagcctagagtccggctgttggctagagtgggcgcggatctggtgtggggaaggcggcgggactcaggcctgcctgcgaagcattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaacatacaaatagtgtatataaaaacggtttatttttcttctctatt

SEQ ID NO: 10718 - DNA, 428 bp, Homo sapiens
aaaactcagacaggaacatttatttttattttgttaagtcaatgcagttttcatctagaaatatagcaagagctctaccatttttttatttgaacaattgcttaaaaaaaaaaagaaaggaatgattatgtagaaatgtttttgatgcagaattactgagcctggaggcaagggggcggggcggggcggggcgggtggaagatagtgcccatcttctattagcagcaggatgtatgagcacagatgacaatccggtccatgctgttcatcagacaaagcctgaatcctggaaaaagccaactctttgaacaggaattagagtgtgatcggctcagttgacgtacaggggtaggtgagtgcgagagtaaagaagctcttctttgtcttcggtagtgctgggtttcttttccaggcacacagatggcctg

SEQ ID NO: 10719 - DNA, 420 bp, Homo sapiens
ctctggagtaatgaaagttaccatctggctttgggagcttcctgttgtacatgaagatgtttgggaggttttatcgtttagcttttttgagtgctcacaatgcagatggttctggggtgaatgggccttgcaagtggctggaccggcaatggcaagcctcagctgagcctgattcatagtgacagttcttctgtctgcaatccataggaatttgggggacaaaaggagggcaccactcactgataatttatgcacacttagcatcttcaacttagaagcactttgttcttccaaataatgctttttcaaatgtgggtggtcagcttttcttattatttccctttaccaactagactgtagcctttgtttcaattccatcattctccacacttcccaccatttcagccttgcccatgtgta

SEQ ID NO: 10720 - DNA, 456 bp, Homo sapiens
accattctgctaattcctcagccaaaggaaatcacacattctttctatacctctttctccttacacattctgaggccaccaaggtacctccctcccctcgatcttttattccatggaggaaaaggctgaagactaggtactagttgttacagttgaatgctgataactggtttaagaagataactttcacagcgcaatttttttgttttaacatggtttcgctctgtcactcaggcttgagtgcagcggtgcaattccccgagcctcaaccttcctggtctcaggtgatcctcccacatcagccttccaaagctgggactatgggtatgtgccaccacatctggctaatatttttgtattttttgtagagacggggttttgccatgttgcccagggtggtcttgaactcctggcctcaagcgatcctcctgcctcggccaaagtgctgggattata

SEQ ID NO: 10721 - DNA, 610 bp, Homo sapiens
  misc_feature (44)..(44): n is a, c, g, or t
  misc_feature (604)..(604): n is a, c, g, or t
  misc_feature (606)..(610): n is a, c, g, or t
attgaaagtaatggatggtagtagaggcagagttagcttttaantatacgtgtgaccattccagttccacccgactgggctgcagatctggctgtgtgcctgccacttcaggcgcagttaatggaataatagcttcctagacttattgagggagacggcttgtcaggttcaaagaattacttttaaaatcttcctgttatagccaagattcagtggtccaaagtcacctaagcataaaagctgccatgagatgggaacatgggggcctgtcctctgtggctcaggcatagcagagtcagttttgtatatagaaaacacatcaagataggagggaagaggaaactgaagctagtattttctagatttagggttaagaatgggacagtgacatggatgagccagttttctcttttgtttttctccccatgaggttacaaaatgagcaatggtaaattctcacttcttgttttccctgttatactcaacattagctttgaatccctttttcctgctttctctaaactgtgctgagaatgaatggcaaacaactccagggacagctgaatctaagctatgcctttgtgtatactatacaaaaagaaanannnnn

SEQ ID NO: 10722 - DNA, 398 bp, Homo sapiens
tacccagtaaagaacctatcatcctcttggcttgtttaacaatatgcctctcacatctgtcttgacttttctgctaccactgccctagtttggttcaggcccttatcacttcacctctagagtactgcacatttccttcaactgatctcttggtgtctaggccttccctcggctgttcttttacacaagccgccatcaggttaattttcttaagtggtggtctgttcacatcacattgctcaaaagtccttcactggctctctcctgctctccagagagaatccagactccagggcctgcaattctgaactctacaatctagacccaacacacttctctagccttaaatcccatgacattcctatgtctgtgcctttgcttttgtacctcttgctgac

SEQ ID NO: 10723 - DNA, 305 bp, Homo sapiens
aaacctagagttgatgaataaggcagcgtcaatctgtataggctaggtaatgatacagtaacaaaacacacacacacacacacacacatatacatacacacacactgaaatccaaatcacggtcatgtgacacgatcaagctatttcttccagttcttccatattctccctaatgcctcctttctgtttcctactcctctattcattcttcctagccactacataatgaaccctcttctttgttttctttcttttaggacttcacttatagcaagctctttcttcccagactttgatagtcgacg

SEQ ID NO: 10724 - DNA, 445 bp, Homo sapiens
  misc_feature (414)..(414): n is a, c, g, or t
cgggagctggagctagcagagctggaccagtggccccaggaacgggagtctgaccagcacgtggtgcccacagcacccgacaccgaggctgataactgcatcgtgcacgagctgaccggccagagctccctcctgcggcggcctgtgcggcccaagcgggctgagccgcgggaggcgtctccgctccacagcctgggccacctcatcatggaccagagctatgtgtgcgcgctcattgccatgatggtatggagcatcacctaccacagctggctgaccttcgtactgctgctctgggcctgcctcatctggacggtgcgcagcgccaccaactggccatgctgtgctcgccctgcatcctgctgtatgggatgacgctgtgctgcctacgctacgtgtgggccatggacctgncgccctgagctgcccaccaccctgggccccg

SEQ ID NO: 10725 - DNA, 905 bp, Homo sapiens
taaaaaatagataccaaattaagtattttattctgggtttagggaggcttctcctgtgcaacatactttagaccaaggcagtcaagaaatactaaaggggatgctgcaattcctctgcctcagacagtacatttatgcatctgtattataaaaaatgtgccagctctagcaagctcacagtactgagcaaagtgctatagttacagctggctctgtttactctttttttttctggtctgttcctctattgggggggggccacagtagggtgttttttcaggatggggggaagaaggaaggagtttttgtgagttctattttggattttggtgaataagaaagcagagaatttgctagcctgttactcagttacactgaaacatgatgcaaactgactcaatttggagcacagaaggtgctgaaaaatttttctaaggaggtcttgaaatatctaagtctgccttcaaggaaggacttataaaaaaaaatcaccatgtaaataatagaagtatgttgctacttctcttaaacctgacctcttaagtcactactcacactaatatactctaaaagtagccagcatgatatttcaaaaattactttgtgtcctttatcctcagtagagtattaagaggaagatgcttgagtgtagacacacatgtgggtcttctttacaaagtcacgtctacatatgtacaccgttagaagtatgggctctaaatgattgaacaagctgtatttccatatttgtattgtccaacctattttcttttttcttattttcctgaatatgtctgaatatatgtgttcagtataaacatacaattgtgtggacgtgtctatgtgtgtttctaattctatactatcttgaaaatggctcagcgttctagaaatacagccacata

SEQ ID NO: 10726 - DNA, 982 bp, Homo sapiens
ccaataaacccattgtaagttgaaaacattgtaagtcaaaaatgcatttaatacacccaacttaccaaacatcatagcttagcgtagcctaccttaaacattctcagaacacattctaatgcatcatctattttataaaaaggtgttgaatatctgatgtaattattgaatactgaaggtgaaaaatagtagtgtatggataccattgtaatgttgagaaactgtaagtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaaattagtttatgttcaaattgttgtatcagtatggtattttgcacctttaccttaaacaatattttctcctttaattattgattttgcaacattttgggaaagttggaattttaaataaatgaataattttctaaaccagaataccagttcaacagccaaataattctgtctttccatgctgtaattttaaagcatttaattttccaactttttgttcatactcaagtgtgtgaacttcctggctgggcacagtggctcatgcctgtaatcccagcactttgggaggctgaggacctcaagtggagacctcaagtggatcacttgaggtcaggagttgaagaccaacatgttcatggccaacatggcaaaaccctgtcttaaattagccgggcatggttgtgcgtgcctgtaatcccagttactcaggaggctgaggcaggagaatcacttgaacctgagaggcagaggttgcagtgagccaagattgtgcagcctgggcgacagagcgagcc

SEQ ID NO: 10727 - DNA, 174 bp, Homo sapiens
ctatgtcacgtgtcctattctggccttcatctttaagtgatgttctccaactcttggaaaattctagaatgccttttgcttagaacattcactaaattatttatacagcatatgggtaatcttggcatgtggtcaaatatcatggatactaagagcacttgaaagaatgttttc

SEQ ID NO: 10728 - DNA, 506 bp, Homo sapiens
actcaaaataattatgccagcatctactgtcaagagtatgattacttaaaggtttattttttattttttgtgtcattctttttgtctataggtatatcccactgggctagataatcaaattactttttgttgttgttgttgttgtttgacctggggtcttgctgtgctggccaggctggagtgcagtgactgttcaccagtgtgatcatagcgcactacagcctcgaactcctaggctgaagtgatcccaacacttcggaaggccaaggcaggaagatcgcttgagcccaagaattcgagactagtctgggcaacatagcaagaccccatctcttaaaaacatattttttaattagctgggcatggtggtgcatgcctgtcatcctagctccttgggacactgaggtgggaggattgcttgagtccaggaggatgtgtttgcagtgagccatgtctgcaccactgctctccagcctgggcgacagagtgacacctcctttcagaaa

SEQ ID NO: 10729 - DNA, 340 bp, Homo sapiens
actcaaaataattatgccagcatctactgtcaagagtatgattacttaaaggtttattttttattttttgtgtcattctttttgtctataggtatatcccactgggctagataatcaaattactttttgttgttgttgttgttgtttgacctggggtcttgctgtgctggccaggctggagtgcagtgactgttcaccagtgtgatcatagcgcactacagcctcgaactcctaggctgaagtgatcccccgagcacttgtgactacaggtacacgccactgtgtccagctacaaattactgggttttaaagttgctttgaatagtttttcctctgtctc

SEQ ID NO: 10730 - DNA, 3716 bp, Homo sapiens
  misc_feature (711)..(711): n is a, c, g, or t
  misc_feature (2069)..(2069): n is a, c, g, or t
  misc_feature (2416)..(2416): n is a, c, g, or t
  misc_feature (2754)..(2754): n is a, c, g, or t
gctctgctgcggaggccgtagccgcgggtagttgggaggaaccgagatttacgcttggtaaggcaagttgcgagctgtccggcgccggtcgagttcctgccgccgtcgtcgtcaggcaggggagaagggggcccaacccctctagtgacagctgtttgctacctaatagggcttttcatcccaccgggccccagggccttcgttaggagcccagcaggctcaacttcttgctgtggttctggaaaagggagtgaccacctggctcaacacctctctctgtgatgtgtttgggagttttgggaaatgagacggctccgagggaagagcttgagggagcggcgtcgcactcgttcgaccttcccgggcctgggctttgtttctaggcattttaggttgaacgctctacatcttaactgagggcaggggaggtggccagagcatcccgctgagcgttttccgattccccagatggccaggcacctggtcctggtggctggacagtgaccccgtggacgcacatttacagctatagccattcagtgccgcggggaggtgaggatagtgatcctgggacctgctcgaggattcacccttgccccaagaacctgttccattcccaggaatgaaggcggtcaggcaggggaggagaagggggcctcaactcttctagtgacagcagtttgccacctaatagagcttttcagattttgnctcctcaggccattttactcagcctcggactatcaaggatggtcacattgaagctgtttttctgcagtcaggagcgaaaagtcccggctgttgaaggagaaactgaatctggttcaggagtcccaggttcctccctctgagaggccaggtggggcctgcgtgagtagcagttgttcaggtggcaggacactgctgttttcatcccacctggccccaggcccctgattaggggcccagagtgcttatgtacttgcctcggtctgagaaagggagtgactgcatagcccaacacctgtgggatgcctcactgcccagatgtttcatctccgggatgcttcattgcccattcagcaccctctatggtgctgactcttccggaagatgtttctgattccttgctaggctggtggttgcaccatagctgagaggactcaagaagagcctggtctcagcttcacctaggagtcccggaggagtaagaaacacgtatctttcctgttctgggcacatatgggtgggtagcagagctgaggctagctgaggatcccgactctcctttgggagcctttgttgtgccgctctcccaggctgatcagatctggagagctaacagcttcctgtggccacatctgtgtccaaggctgggcccatgcctgtagccagattgccaggatctggaaggggccaagagacagctggtgctgggtaggcagcagccctgtgtcaacctgcccccactattaccccatgctgtgatttgcatgtggtctgcccctgcccaaaatggtattgaaatttgagcctcaatgaggcagtgttaggaggtggtgcctagtaggaggagtttgggtaataggggtggatccctcatggataggttagtgtcctttgtggaggggtgagttcccatgagagctggttagagagtcagccttcctgcggttgtctcttgcttcctctctcgccatatggccacgtaatctctttgtgcatgcctctccccttctacttgctgccttgagttgaagtagcatgaggccctcaccaggtgcagctgcccaatcttgaaatttccaccagaattttgagccaaataaacctgttttgctttttttaaaaaataaattcccccaccttggctgggcgcagtggctcacgcctgtaatcccagcactttgggaggccgaggcgggcggatcacgaggtcagatcgagaccatcttggctaacacggtgaaaccccatctctactgaaaaaaaaaaagaaacaaaaaaattagccaggtgtggtggcgggcacctgtagtcccagcccctcactcgggaggctgattgaggcaggagaatggtgtgaaccngggaggcggagcttgcagtgagcccagatcgcaccactgcactccagcctgggcgacagagcgagactccgtctctaaataaataaataaataaataaaacaaacccaacctcaggtatagcagtgtgaaacagactaagacattccacatgccctgtggtcccatctgctaccccagggtgcaaagatgttccctcagccctgaagaatgacattccccccggctcctgggatatctggaggggttgtaagcagcttgggttggtgagataaggagtttggggggcagctgattcatgaccctggcctcctcaactgcaggctcttggtctgaagtactgtaattnaagtatgagagcctcggggccctcacttcaaggagggaagagcatccccatgcctcagcgtttggggattgtagggagatgagagtccttcaggtgggactagttcccgccatgaccccactgctggccagtggcctgaaacgcatctgaccacttctcaggttcatgggtgttgaggaggagccctgtggaatcaaccctgtctgcctcctcttatcctgccactcctcttgctctgtctggatgactgcccttgtttttcaagggaatgttccctgtcttcctcagccaggattttttctgaacttgacatctccgtttgttcagggggcaatcantgggcacttcactgtgctggtccttgcattctcatggagatgcagagattaaaaattagtatcttgtccacatactgcccagagttagcaaggattgcttttctgtggatttgtctcaggtcgggcacagtgggggtagggtccttctcccttttcctagcctaaaggttccagctgaatcttcccaggcagggctgaaacaggaaccattttaggctttgctgcaacccatggtcagttctccaagaaaagtgaagagggttccacctggggcagccctcaagggctcagagggccaaaacacacgtacaacatgttgagacactgagtttgtgcgatcctcacacatctcagcagtgagtatttctgcctcattttaccgatgaggaacctgagcttcaaagggaagaggtgacagctcaggaccacacagctgtaggtaggaggcaggaaaatagggtctgagtgcagggaacataggctgattcacacttcagttatgataggaaataccttctccataggacataggccaagcaaatgactttgtaacttcatcctctccatctgcataacgtgtgccccaagtaaccaatggaatcacctagagggtgtttaaactctcagaagttctgtaacaggctctccatctacataacgtgtgccccaagtaaccaatggaatcacctagagggtatttaaactctcagaagttctgtaacagggcttttgtgctcctatgctcaggctcacccccacactgtggagtgtactttcattttcaataaatcccttcattccttaaaagaaaaaaaaaacaaaaaaaaaaaaaaaaccgcgggcatcttttgcggggcgggaaaagagggtttgaagggccccgggctaaaggttccggacccgttttggcccagggggaaaccgggggccccaaaggagcaaaaaccaaacccggaccgtaa

SEQ ID NO: 10731 - DNA, 3557 bp, Homo sapiens
  misc_feature (711)..(711): n is a, c, g, or t
  misc_feature (2069)..(2069): n is a, c, g, or t
  misc_feature (2416)..(2416): n is a, c, g, or t
  misc_feature (2754)..(2754): n is a, c, g, or t
gctctgctgcggaggccgtagccgcgggtagttgggaggaaccgagatttacgcttggtaaggcaagttgcgagctgtccggcgccggtcgagttcctgccgccgtcgtcgtcaggcaggggagaagggggcccaacccctctagtgacagctgtttgctacctaatagggcttttcatcccaccgggccccagggccttcgttaggagcccagcaggctcaacttcttgctgtggttctggaaaagggagtgaccacctggctcaacacctctctctgtgatgtgtttgggagttttgggaaatgagacggctccgagggaagagcttgagggagcggcgtcgcactcgttcgaccttcccgggcctgggctttgtttctaggcattttaggttgaacgctctacatcttaactgagggcaggggaggtggccagagcatcccgctgagcgttttccgattccccagatggccaggcacctggtcctggtggctggacagtgaccccgtggacgcacatttacagctatagccattcagtgccgcggggaggtgaggatagtgatcctgggacctgctcgaggattcacccttgccccaagaacctgttccattcccaggaatgaaggcggtcaggcaggggaggagaagggggcctcaactcttctagtgacagcagtttgccacctaatagagcttttcagattttgnctcctcaggccattttactcagcctcggactatcaaggatggtcacattgaagctgtttttctgcagtcaggagcgaaaagtcccggctgttgaaggagaaactgaatctggttcaggagtcccaggttcctccctctgagaggccaggtggggcctgcgtgagtagcagttgttcaggtggcaggacactgctgttttcatcccacctggccccaggcccctgattaggggcccagagtgcttatgtacttgcctcggtctgagaaagggagtgactgcatagcccaacacctgtgggatgcctcactgcccagatgtttcatctccgggatgcttcattgcccattcagcaccctctatggtgctgactcttccggaagatgtttctgattccttgctaggctggtggttgcaccatagctgagaggactcaagaagagcctggtctcagcttcacctaggagtcccggaggagtaagaaacacgtatctttcctgttctgggcacatatgggtgggtagcagagctgaggctagctgaggatcccgactctcctttgggagcctttgttgtgccgctctcccaggctgatcagatctggagagctaacagcttcctgtggccacatctgtgtccaaggctgggcccatgcctgtagccagattgccaggatctggaaggggccaagagacagctggtgctgggtaggcagcagccctgtgtcaacctgcccccactattaccccatgctgtgatttgcatgtggtctgcccctgcccaaaatggtattgaaatttgagcctcaatgaggcagtgttaggaggtggtgcctagtaggaggagtttgggtaataggggtggatccctcatggataggttagtgtcctttgtggaggggtgagttcccatgagagctggttagagagtcagccttcctgcggttgtctcttgcttcctctctcgccatatggccacgtaatctctttgtgcatgcctctccccttctacttgctgccttgagttgaagtagcatgaggccctcaccaggtgcagctgcccaatcttgaaatttccaccagaattttgagccaaataaacctgttttgctttttttaaaaaataaattcccccaccttggctgggcgcagtggctcacgcctgtaatcccagcactttgggaggccgaggcgggcggatcacgaggtcagatcgagaccatcttggctaacacggtgaaaccccatctctactgaaaaaaaaaaagaaacaaaaaaattagccaggtgtggtggcgggcacctgtagtcccagcccctcactcgggaggctgattgaggcaggagaatggtgtgaaccngggaggcggagcttgcagtgagcccagatcgcaccactgcactccagcctgggcgacagagcgagactccgtctctaaataaataaataaataaataaaacaaacccaacctcaggtatagcagtgtgaaacagactaagacattccacatgccctgtggtcccatctgctaccccagggtgcaaagatgttccctcagccctgaagaatgacattccccccggctcctgggatatctggaggggttgtaagcagcttgggttggtgagataaggagtttggggggcagctgattcatgaccctggcctcctcaactgcaggctcttggtctgaagtactgtaattnaagtatgagagcctcggggccctcacttcaaggagggaagagcatccccatgcctcagcgtttggggattgtagggagatgagagtccttcaggtgggactagttcccgccatgaccccactgctggccagtggcctgaaacgcatctgaccacttctcaggttcatgggtgttgaggaggagccctgtggaatcaaccctgtctgcctcctcttatcctgccactcctcttgctctgtctggatgactgcccttgtttttcaagggaatgttccctgtcttcctcagccaggattttttctgaacttgacatctccgtttgttcagggggcaatcantgggcacttcactgtgctggtccttgcattctcatggagatgcagagattaaaaattagtatcttgtccacatactgcccagagttagcaaggattgcttttctgtggatttgtctcaggtcgggcacagtgggggtagggtccttctcccttttcctagcctaaaggttccagctgaatcttcccaggcagggctgaaacaggaaccattttaggctttgctgcaacccatggtcagttctccaagaaaagtgaagagggttccacctggggcagccctcaagggctcagagggccaaaacacacgtacaacatgttgagacactgagtttgtgcgatcctcacacatctcagcagtgagtatttctgcctcattttaccgatgaggaacctgagcttcaaagggaagaggtgacagctcaggaccacacagctgtaggtaggaggcaggaaaatagggtctgagtgcagggaacataggctgattcacacttcagttatgataggaaataccttctccataggacataggccaagcaaatgactttgtaacttcatcctctccatctgcataacgtgtgccccaagtaaccaatggaatcacctagagggtgtttaaactctcagaagttctgtaacaggctctccatctacataacgtgtgccccaagtaaccaatggaatcacctagagggtatttaaactctcagaagttctgtaacagggcttttgtgctcctatgctcaggctcacccccacactgtggagtgtactttcattttcaataaatcccttcattcctt

SEQ ID NO: 10732 - DNA, 407 bp, Homo sapiens
ccaaaatctaacccaacataacttagattgggtatacgcagagcaatgtagagtcatataaagatttaattaaacattttaaatgttatttgcctaacacttctttatgtttcagagtcctgcctctgtgatacagtcacataccacataatgatatttcagtcaatgatggactacatattacacattagtcccataaaatgatgatggcactgaaaaattcctatggcctggtggcatcatagccatcaaactgtcatagtgcaaagccttgctcatgggcttggggtgatgctggtgcaaacaaacttcctgtgctgccagttgtataaaagtctagcacacatcaatatgtagagtatacaatatgtgataatgataataaacgactgtgtgatgggttcatg

SEQ ID NO: 10733 - DNA, 295 bp, Homo sapiens
taagatgtagattatatgtaaagcgaaagtatattatatttgaaactgacactccagagaggaggaaggccagagaagatgcaatatttgaagaaataatggtcacaaattttcaaatctgatagaagacatcaagatatagattcaagtggatcagtaaactcttaaacagggtaaatacaaataaaagcataccaggacacatcatagtaacattgctaaaaataaagacaatgagaatttaaaattaacccaaaaaattaaggtctcaaaagcagacagcttatttgataat

SEQ ID NO: 10734 - DNA, 446 bp, Homo sapiens
acactccagggtcatttttcaacttctcattgtctcacacctggaacactcttcatccagggagcctacacgtgttcatcatctatctgctcaaaggcaccttaacaaagagctgttcccaccctacaagcacagtgccaactcctaacacttactgttccaccagctgctttaactttccttatagcaatttttactccaagatatgttatttatatatctgcttattactggttatatggttacttctaagagaacaaaagcattgtgaagaataaggacatggtatgttttttctttcttatttgtactgctgatagcgttggaatatagtaggctatcaaaacacaagttttgggtgtgtggtggaggcaggggggtttgtcatccagcctggagtgcagtggcatgaacttggctcactgcaatgtctgcctccagggttc

SEQ ID NO: 10735 - DNA, 577 bp, Homo sapiens
gatattaagcaaatttgacagtcctaaaatcacaagaagaatgaagatagaacctgaaaacgtttgcgcagacagtggagaataacatcatctgcggggagactcagtgatggatagatggctttactgaacctgggaactcgtacctcctgctggcgtggccatgaacacagtggatcaactaaaagctcctgaattcttattgctatcctatgctgtttctcaccattcctgcatctatatgtgatcgcagagcctgctttataactcatcagctaccatagcagctgactttttctgccacactctcaagagtcaacaaagagaggccaagcattctcccccactccccactgagagagtaggattgaaggagagagtgtgaacaaagggtctcagaaggttgagaaccactgaactaacattctctaaggatcatgatgaccctgagattctatgattctgagtccaagcattctgagtcttggttccacatctgtaagatggacacacccctgttgactcacagcattgttgggaagattggcagaaagttctaaagaataatggtggccgg

SEQ ID NO: 10736 - DNA, 604 bp, Homo sapiens
cccagaagtatggctggtgtctacacacactgaaggggcatctgcctgtgaagtagctggtggttctgaggcctgtctgcatcctctcctctagtttaatccaattgtcagtataccagtgaccaggagctgcaagtcctcctcttgtgaaccattctttcactactctgggatggctttgaggttgagaaagcacagactgatggttctctctattctgatagataatttcctgaaggtcaatgccatcttcttaagtattgcctctagctaaaagtaccatttggcttttgtttgttggcttaattgaatgttctttggagatgtgtgtatttgtacactgaaagtaatggaattaaccctacactttgaagatgatcttcaagttaaaatatctcgcagcatgaggaaagagggaaagggacagagagcaagggtgagaatgagagcaagactgagagagtgatatgtatgtctgagtaaggcaatgagttaggagagagagaagcccaggcagtcttccttctttattgctgagaagtcacatccacagagactggcccacatcctaattctgggccaacagctccattgtgcaatacca

SEQ ID NO: 10737 - DNA, 224 bp, Homo sapiens
gctccttaagcaattgagggtcagcagtgcctggtggccagcaatgtttggctttgcaatgaagtatggcacctcccgttggaagccttcctatagcatcctttgggaagctttgcagcaggttctgagtcacaccaccgctccacggacagctttctcaagcacccagaaactatattatcagcaagtcctgccagcacaacacctcagcaaattcctccacc

SEQ ID NO: 10738 - DNA, 487 bp, Homo sapiens
gaggagttcaggcaccatagctgaaagaagcatttgaataggcagagatgctttaaaatgagacaagatccaccccgtaaaacaggccactgaaacattttttaaaaggtagctccatggcctttctaggagactcatctctgccttcattctcctgtaggtataaccaaggcaaggaaagcccactccagtgttctggccttgtggagagtggacagccatgcagatgggctcaggtccctggagggcaggcacttggaattcctccctggattagtcctatcctgccttctttccttttcagcctcccaagctgcttccccaatgactgccctcccttgcttttttccggccacctgctctcaacaggagctgcagaccctttggacaaagggcctgccagatcctggggcaattcagcctctggttggagcaggtggaggctgggccagctggggccatgaggaaggaaatcaaagcaattgac

SEQ ID NO: 10739 - DNA, 232 bp, Homo sapiens
tccatagggtagcttttaatagcaaaatcaccagaaggcagagagaagagaaaactcaagagccctgaaataatctccaaacttaattaccaattctaaataattaagagttaactatagtatacttcatccatcatgaggaaataattagcaggaattaaaacttgagcactattttgttcttcttacctttttcacttatgcttggaaataatatagatggaatattcag

SEQ ID NO: 10740 - DNA, 315 bp, Homo sapiens
aaattagcagggtgcagtggcacaccccccgtaaccccagttacttgggaggctgaggcaggagaattgcttgaacttgggaggcggaggttgcagtggcgcagccatggctcactgcagcctcagtctcagtctcacaggctcaagcagatcctctcgcctccgcctcccaaagtattacaggcatgagccaccatgcctcttaggcctggtttattttgaaaagtatcattgctactgtgtgtgagcagccctaacttcaccgaagacagaagaaccaacaaaaagaagtataaatttttatttacttaatta

SEQ ID NO: 10741 - DNA, 701 bp, Homo sapiens
aaattagcagggtgcagtggcacaccccccgtaaccccagttacttgggaggctgaggcaggagaattgcttgaacttgggaggcggaggttgcagtgagtcaagatggcaccactgcactctagcctgggcaacagagtgagacactatctcataaaaaagagaaacattctgttttttagtatttcaacagattaagaacagctcagtccattgctgtgtttaagatagattggggttattttgcttagacacattttagaagcttcctaaatttttttaggaagttttttttggatgtttttgtttttgtgattttcctaaagaaaattttgacagtaagcagatgttaacttttgagtccaacagtatttccctatttctttccttttcttaggactgttttattttattttatttattttattttattttatttatatagacagagtcttgctctgctgcccatgctggagtgcaggtggcgcagccatggctcactgcagcctcagtctcagtctcacaggctcaagcagatcctctcgcctccgcctcccaaagtattacaggcatgagccaccatgcctcttaggcctggtttattttgaaaagtatcattgctactgtgtgtgagcagccctaacttcaccgaagacagaagaaccaacaaaaagaagtataaatttttatttacttaatta

SEQ ID NO: 10742 - DNA, 612 bp, Homo sapiens
gtttcaatttgctatcacacacacagtcacacacagtcacacacacacacacacacacactcaaacacacataatcttttgctcacccactctgtctctctgcccgtctatgggataacactctactatttatgtagtcaatataacaaacaagagatagcctttgaaatggcaattgggaaaagcaaaaatgatcattgataacttaatagacttttttatatgtcagagttcaagaaaccaaagtttgcaacttaaatctcagttttcaaacagtaaaagtttgtatagatggcactacagaaaaataaaaatggttattcctaccagctccagaaatgtgttacacaatatacactagaagactttttttttaataatagtattttgtccttaggtagtattgttcctttcaaccaaagactccagaattattgaaaaacaaaaaaggaaaaaaaaaatgagataatgggggaaaaaaaggacgctgcttcacaccaaaggtttaaaaaaatattttccaaatgcactaggaacattgtaaaaaccagaaaggagtgaacagaatgctaatgaagatactgccctaaagaaatctgtacaaaaaaaaaa

SEQ ID NO: 10743 - DNA, 466 bp, Homo sapiens
tagtggcaatcgctaactctgctggggaaagacttgctaattttcttttaattgcataagagcagagccctacagcaaattgaacatgtggtgactacatgaaatatatgatagaatatggtcctactttgattgagttaatcacaggtctgacaaatatacaaaattaaaataagccacattttttagtacttaatctcttgattctgttgctttttactgtttgctggatagtcttacgttgtttttaggaacctatggttcttcagtgctaatttgttggatatagacagcagtttgctattcgtgactctaatgggtgtgtaattccctttcttgtatgcaattgggcatttcagtatagtttacaatatggaacgtggaggggaccccccgagtaggacagcggctgctctttgtcacttgcagctgtgtttgcaagggagcatgctggcaaccagcaagg

SEQ ID NO: 10744 - DNA, 529 bp, Homo sapiens
aggaagataaaggatcatatcattatgttctttgaaacaattatggtaaggaataaaactagttaaagttttttgaaaaggctatcagtagtaaaagcaaacaatttgttagaaagtaagattaaagttggttaataattaaaattttggataataatgctagtctagcaacatgctgaggtaatcataaggaactctagaatctgataaaattaaggcatgttggcaatcctctctctgagatgcccttctccctctattaatccacagctagcaccaccttcaaatcaggctcaagaatcacttctaggctttcccaaattaatctcacctcactctgatcaccctttactgaatctccactctttgtttagccaacatattaagcaactactgtgtaccagatacattgtggaaaagaatattaaaaatctggtccttggccagacgtggtggctcacacctgtaatcccaacactttgggtggccaaggcaggaggatggcttgagaccagtctggcaacatagc

SEQ ID NO: 10745 - DNA, 2707 bp, Homo sapiens
gtcttgaacctttgtcacccctcacgttgcacaccaaagacataccctagtgattaaatgctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggtccactagactgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggca

SEQ ID NO: 10746 - DNA, 771 bp, Homo sapiens
gtcttgaacctttgtcacccctcacgttgcacaccaaagacataccctagtgattaaatgctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggaggatgttgtctcttacacccaggttatttgttaaagtctttggatctatacttaactgatgacctagaagagcgattctcaaaagtgtgagtcctggaccagcagcaacagcatcaccgggaacttgttagaaatgcacattctcaggccactccctagacctactgaatcagaaaccctggggttggagctcagcaattaccctgcaggtaattctgatgcatg

SEQ ID NO: 10747 - DNA, 1288 bp, Homo sapiens
gtcttgaacctttgtcacccctcacgttgcacaccaaagacataccctagtgattaaatgctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcagcaacaactacaagagttttacaagaaacagcaagagcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagaggaattccccgtccaagggcccgctgcagtctgtgcaggtctt

SEQ ID NO: 10748 - DNA, 1095 bp, Homo sapiens
ttttcctgcccttctcttgggcctttgcagctaaatctggtgtctagtgtcaccatgtcgaagaatatgttggagacatccccacagagcttacctcaaacccctaccacaccaacggccccagtcaccccgattacccagggaccctcagtaatcaccccagccagtgtgcccaatgtgggagccatacgaaggcgacattcagacaaatacaacattcccatgtcatcagaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggtccactagactgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggca

SEQ ID NO: 10749 - DNA, 933 bp, Homo sapiens
aaaatagctgtatcagtcatttctaaaacgcttctgatctcactctttcttaacagctttctaaagaacgcgaacgtcttcaagcaatgatgacccacttgcacatgcgaccctcagagcccaaaccatctcccaaacctaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacagggtccactagactgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggca

SEQ ID NO: 10750 - DNA, 1928 bp, Homo sapiens
gactttctatacccttttgtttaggattttttggattctggattggaaaatttcagagctgccttggaaaaaaatgtatgtagagctgtctctttgaatccaatgtatattttttgttgtttttatgggatgaatcttaatggatactctgccatatgccagtctagaagagtttaggagatttataatacgtgaaacttttgcctttatttattaaagtcaaaatggtttcagttacatcttcagcttttgcagcagcagcagcaacagcagcagcagcaacaacagcagcaacaacagcagcagcaacaacaacaacaacagcagcaacaacagcagcagcagcagcaacagcagcagcagcagcaacagcatcctggaaagcaagcgaaagagcagcagcagcagcagcagcagcaacagcaattggcagcccagcagcttgtcttccagcagcagcttctccagatgcaacaactccagcagcagcagcatctgctcagccttcagcgtcagggactcatctccattccacctggccaggcagcacttcctgtccaatcgctgcctcaagctggcttaagtcctgctgagattcagcagttatggaaagaagtgactggagttcacagtatggaagacaatggcattaaacatggagggctagacctcactactaacaattcctcctcgactacctcctccaacacttccaaagcatcaccaccaataactcatcattccatagtgaatggacagtcttcagttctaagtgcaagacgagacagctcgtcacatgaggagactggggcctctcacactctctatggccatggagtttgcaaatggccaggctgtgaaagcatttgtgaagattttggacagtttttaaagcaccttaacaatgaacacgcattggatgaccgaagcactgctcagtgtcgagtgcaaatgcaggtggtgcaacagttagaaatacagctttctaaagaacgcgaacgtcttcaagcaatgatgacccacttgcacatgcgaccctcagagcccaaaccatctcccaaacctaaattgccccaaactatgaattttataaaaatgcagatgtcagacctccatttacttatgcaactctcataaggcaggctatcatggagtcatctgacaggcagttaacacttaatgaaatttacagctggtttacacggacatttgcttacttcaggcgtaatgcagcaacttggaagaatgcagtacgtcataatcttagcctgcacaagtgttttgttcgagtagaaaatgttaaaggagcagtatggactgtggatgaagtagaataccagaagcgaaggtcacaaaagataacaggaagtccaaccttagtaaaaaatatacctaccagtttaggctatggagcagctcttaatgccagtttgcaggtccactagactgccttggcagagagcagtttacctttgctaagtaatcctggactgataaataatgcatccagtggcctactgcaggccgtccacgaagacctcaatggttctctggatcacattgacagcaatggaaacagtagtccgggctgctcacctcagccgcacatacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggca

SEQ ID NO: 10751 - DNA, 1071 bp, Homo sapiens
gtcttgaacctttgtcacccctcacgttgcacaccaaagacataccctagtgattaaatgctgattttgtgtacgattgtccacggacgccaaaacaatcacagagctgcttgatttgttttaattaccagcacaaaatgccatcagtctgggacgtgatcgggcagaggtgtactcacagtagtgtaaatactgctgtaaatagttgtctgatggtggctttgacagtgagctagcttctgagttttcccttctttttatactgttttctgtgctggcttttttgaatcttcctaatttttcatctctttaacaaactcctatgaagttgaaaccgggaagtttgctctaacatttccagagaaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggctctccaggcagcaagacaacttcttttacagcagcaaacaagtggattgaaatctcctaagagcagtgataaacagagaccactgcaggtgcctgtgtcagtggccatgatgactccccaggtgatcacccctcagcaaatgcagcagatccttcagcaacaagtcctgtctcctcagcagctacaagcccttctccaacaacagcaggctgtcatgctgcagcaggtaatgtgggttacctgctttggtgttctagcatgacttagaaggtgtgcacttattttgaaagtgcagtgggcatatttgacaattcagtctccatttgaaaggacaacctattagcgtgctagaacataaatgtaacattttaattatagaactcgtaagaaaatctagattgcttatttttttaaaaaaattattaaagtctagaataagagcagagagaggtgtaatttgaaaatggaatgagccaatatttaaatattcaaatgcttaggtacattcaatttgttgacttgcca

SEQ ID NO: 10752 - DNA, 1565 bp, Homo sapiens
gtcaatatcatggtacttatcacattgtagttacgtgtttccatttctgtttctcacattagtctaaaaacttgtgaaagacagggagtgtgtctgattcagctttgtgtctctatttcacagctgaaggacctggcccacagtgtgcccagagaagtttgattgaatggttcattcactttactcagtctggcaatgttgggggagatggccatgaattccattgctttccttccctgctaatcttatttaaaggattcattggctttaaggactttgcctcatccaaggcttcatttgtttcagagaaagcccaaagactgtaacctgcagtcatttgtcatttttttgaggtctcaaatgatcagataaacctgggaagctagtgagtagacgtgagttattttaggcaaggcaaatgagcctagctgacctctcgcatccattttcaacaatgccttggttacctccattcacaactgtgtaactcatgtgtactgggaatcctgtgagattgtaggaggaagtcctggggaaaattaatgctatttgagaatttggagaaactgaaaagccttgaaacacatcctttgcagatgtccaggatctagtggagtcagcactggctgtcttcatttgttcacaatcagcttcttgcttgactccctgcatctggcttcctgtcctccatcccctgaaaaccacatgctctgaggttaatgaaagcctctttggggcttaaataatgggacctctgcagcatttcactcccttgttcatgaagttctcttctcccttggcattcatgacatctgtttcctgattctcttgcttctctggttgtgccttctcaatcttctttgcagactctgcttcctgggcctatctcttaaatattgaggttccttgggacttggtgatagaccctcctttctctctttaccctctcagggtaatgtcatccacgcccatggcttcaggaaccatctctgcaccaacatccacattcatgtctccaggccagacctctctcttaggcttcagcgtatctttccaactgccaactggacctctccacttgaattacatcccataggcacctcagattcatcacattaaacagtgaactctagctgggtgctgtggctcatgcctgcaacccccacgctttggcaggccaaggcaggaggattagttgagcccaggagtttgaggctacagtgagctatgatcataacaccacattccagcctggacaacagagtaagaccctgtctcttaaaaaacaaaaacaaaactgaaaaaaccttaaaagataaacaccaaacttatcaccctctcatccaaactgctcttctttgagagtttccaaagaatcatctgttaattccttcttctcccctaactcttcacatgtaaatacccagccaccaagttcagttgatatccccctgcaaaattgatttatcttggcctgtctttgctattctcctaatcaaggcagtttcttaattttccgtccttgccctttaaactattttccacatagcagaccaaaaaaaaac

SEQ ID NO: 10753 - DNA, 462 bp, Homo sapiens
tattagccataatttatcatgttactcagcaaatccactcctagccatagatacataagggaaatgaaaacatgtccatgcaaagacttctatgcaagtgtttatggcagcattattcataataaccccaaacaggaagtagcccatatggcccccagctgggggaatgggtaagcaaatttgtggtatatccatagtatgaattattactcagcaataaaaaggaataaaatattaaatcacacaatgacaagaatcaatttcaaaaacatgctaaagaaaagaagtcaaacacaaaagatcatatattgtatggttctttttaatgaaattctagaaaatgcaaaataaagcactcaatcatcaaaattcatccaacactacaattttattgtatgtaatttatatctcaataaagttattttaaaaaataagtatttttaaaacccaaaaagatgagaa

SEQ ID NO: 10754 - DNA, 347 bp, Homo sapiens
tttcatagttttgattttgggataccataaatgcgagtttcctaactgtacgcaacagcttgcctactataggtatggtaaggtcccatcagccctccagtggctgggtgggcactctgacagcttgaacttctcctggttgcctctggcttccagcagcctcatcagtttactgttagatgccatacaaatatgattttctctgtgtgttgacatgaaaaaggttgggaaggatagactatttgaaacacccagacttgttttttttgttttgttttcagacggagtctggctctgtcactgaggctggagtgcagtggcgccatctaggctcactgcaacctcca

SEQ ID NO: 10755 - DNA, 321 bp, Homo sapiens
gtctgaggagaatctggttcaacagcttcactttagcatactgcttgtgatagggaagcaatggaggagatgctccaccagttgttggctgcaatttagcaagggccacttggcacaaatttaatggctccatacaccctccagaggcgcctttttgtcccagattctattccaaggttcagtctgaagccctaaaagaaaatcagatctgagggatccagaggcagtcaacagtagaaggctagggcacagcccaggtgagcatgactatcccttctgactcggtcttcccacttcatgggtggagaactcgtgcacatc

SEQ ID NO: 10756 - DNA, 334 bp, Homo sapiens
agcactgtgttatgacttagtgatggcattactccgttggaaaagtcttgttccttttctgactcatgatggcgtcccttaacttgaacgaatctgtgatgccctcgcttcttttcattccctgatgtcggtgccttaatgatgtcacatccgtgtatgcagcatctcccgggatgcaagagtttcatgggttttctaagggcctgtgacgggtgctctttctactgggtcgattgtctcatgagaatgtgacatttgtgtgccccagctttaggagctaaatatactctggaattgtttctaaaatccatcacatttcctcactaagcagaaa

SEQ ID NO: 10757 - DNA, 794 bp, Homo sapiens
cactagtattatcccctaaagacataagcaaaggacaaggtcagagcagtcagttgtattccttgttagtggctttgataagaggctttgggggaagaggttgaaactaacggctataatgaagttttgggttctctaaagatttcatttatcggtgctattggtctccccattaaatgcatgcctgttctgtgtacctttgcacacagtttgcataacatataatatttattactgaaaccttgcaaacttcttaaattgtatagaaaaggctgtgaaacttactcttagagaacataaaaatatagagaatgaaggtcataactccaaatattgagtgatacagtgttttgaaaaaaaaaaaaccagaataaaacaaaattagttactagagtagaaaaaatatagttttaatatgtattgatacatgtctttttgccctcccccaatttagtaaagatgcactaggtgttaataatattcttcttatcatacagtgtattttaatctagcattttagaaaactttttacaagttcatagataaaagccctgtcagaatgtgacttttcattttcagatgttgtgaactggatttctgcatgatttttatggaaatgactatacttttaaaatgtaaaacttttaataaaacaaaacaaatttaaagccctcaaaccttttcttggtggacctcatgtccccctgtgattcttaagtatatgttaactagtttcagatgtgttttgttcgctgactcaaaatcagctctttattttaagaaaagaaattgtg

SEQ ID NO: 10758 - DNA, 448 bp, Homo sapiens
gagacggagtctcgctgtcgcccaggctggagcatggtggcgcaatctcggctcactataacctctgcctcccaggttcaagcaattctctgcttcagtctccggagtagccgagattacaggctcctgccaccacgcctggctaatttttatatttttagtggagatgtggtttcactctcttggcctggctggtcttgaactcctgaccaaagtgctgggattacaggcgtgagccaccgtgcccagctgaccttttttttttttaatggcttatgtgctaagaatgggttttacatgtttaaatgattgtagaaaaaaaaacacagctcaacaaccaaaaaaacaactcggttaaaaaatgggcaagccaggagtttgaagttacagtgagctctgatcacgccaccatgctccagcctgggtgacagagtgaaactctgtctgt

SEQ ID NO: 10759 - DNA, 188 bp, Homo sapiens
tgctttaccagctttctgagtatccctcaatctagtcaagttgacaccaaaaattaaccaacataagtccacactttatcaacttctcagccatacacatcttctaaaactatacaatttctatcttaatttgttcatgctgctataacaaaatacctgagactgggtaatttacaaaaatagaattt

SEQ ID NO: 10760 - DNA, 325 bp, Homo sapiens
gctcgacactaattctgagctggtgacaaattctcttagctttggttcatctgatattacatgatttcccctttcatttctaaaaaataatttcactggataaaggattctgggctgacagttctgttcttttcatttcagcaattcaaaaatattgtgccactttcttctggtcttcataatttctgatgactaatccattgtcactcatattgtttttttacttcaggtagtgtcacacctctctctccctttctctctctctctactttaaggaatttttctttatctataattttaaccactatgtatgtcagtatagatt

SEQ ID NO: 10761 - DNA, 379 bp, Homo sapiens
attgcttgttgtcataaatgggccactttgaccacttatgacctccaggagtgaaaaaaattgtaattactaagaaaggaacaaagactacgataaccttaagtgtttaggtcagaggtaaaagccaaaaatattggatcccattgagccagtagttgagcatagctttagtcaagataatctcggctgttttagtggctgccctactacttgtttgggccttcacctagttgcaactgtggcagctcagaatcataatccattttgtttggacaatattttcctcctaccagaactctccagccatggaaaattttttagagtaagggaagaaataacctcttttggaaattagcttggattacactttctaaaacct

SEQ ID NO: 10762 - DNA, 442 bp, Homo sapiens
tgtactctcatcactggaagggcccaagcataaatcaaacaactattgagagtatttttaaagaagatttatagttcagatagggaactatactacgaggaatctaataatacaaagttcctttaaaacacacttaaaatcctataatctcagctcactgcagtctccacctcccgggctcaagtgattcttctgcctcagcctcctaagtagctgggaccacaggcctgcaccatcacacctagctaattttttgtatttttggtagagacagggtttcgccatgttggccaggctggtctcaaactcctgggctcaagtgaacctcctacgtcagcctccccaataactacaggcatgtgccaccatcccccgctaatttttaaaattttttgtagagacaggggcaacatagcgagacaacttctctccaaaaattaaa

SEQ ID NO: 10763 - DNA, 446 bp, Homo sapiens
gagagacacacatagctggtgaaacacaatttctgggcatatctgtgaaggtgtttctggaagacactgagataaccctgacccagtgtggatgggcactgatatggtttgcctgtgtccccacccagatctcatcttgaattgtagttcctataatccgtacatgtcgtgggagggacccagtgggaggtgactgaatcatggtggttgttactgccattctgttttcatggcagtgagtgagttctcatgatccaatggtttcataaggggctgttcccctttggctcagcacttcttcttgttgctgccatgtgaagaaggacgtctttgtttccccttctgccatgattgtgaggcctctgcagccacgtggaactgtcagcccatttaacctctttgttctttataaattgctcagactcaggtatttcttcacagctgta

SEQ ID NO: 10764 - DNA, 463 bp, Homo sapiens
tttttagtactaacaagtttctaatgcaagtgaattctattagcccaagcagggccatgattggcaaggagagaaactatactgcagaataaatgtaggaggtgacatataaagaaaacactgaggtcaaactcatctcaagagaactgaataggatgtaagcaaagacagaggaagaaaatgatgcaggagattcaactgtgttggaatttaggtcattgagagaaaaaggctcatcccaaaatgaaaaaactgcttggaatgtgccagaaaaaaaaaaaaaatcctctctaagaaacaaataaactaagaggaaccaggaagtgttggcagcaagtaaatatgtaagtagaaatatgaggcaaaaaagagctcaaagacagaaaggagaaaatacaaaaaggagtatgctcttagtgaagagtctgagattctgtattttaaagcgtgcctggtgaattag

SEQ ID NO: 10765 - DNA, 321 bp, Homo sapiens
gtgtaaaactgcaagatagaccagcaagacttctgggttatactaaaataattcccccatataagaagtcatataaagctgggtatagtggctcatgcctgtaatcccagccctttggaaggccaaggcgggaggatcgcttaagcccaggagtttgagacaagcctgggcaacatggtgagaccttgtctctacaaaaagttttttaaaaattagcctagcatggtggtgtgcccttggagtcccacctactctggagggtgaaatgcgaggatcacttgaacttaagaagcagaggtttcagtgagccaagattgcacc

SEQ ID NO: 10766 - DNA, 365 bp, Homo sapiens
accttgtctccctaagaggtgatcatgaatttcctatacagggcaaaaaagggaagaatagcctattcatattctgtattcacagtttgaaggacccatcacaaatgaccttcaaagactgacagggggcaggtagaagggaggcaaaaatgcagagaaaaagatgttaccttgaaaaatgaagtaagaaatcctaatattcccgtagttgatcctaaagtttgttcccatgtctacggttatttctaaataacttcactacactttggaaattccttagtggtggtttatcagtaatacttaactgaatttttccgtttctattctttgctgccaatgaatgtaatctccacgacttgccgttc

SEQ ID NO: 10767 - DNA, 786 bp, Homo sapiens
actgacccacctcgaatgaagcctcctccaacaagtctggaatctgtccaaatttaaattaacaggtacttctatgaattccctcagagaacacactgtggatgctttagagacctcttcccatgcatcctgaattatctgggttgcatatggtggccataagtagtccatgggcttctgatgtaaaaacaaacctgccccttttgaccctgctctgtacagcatcagggcagtgattgctgaccatatcctggaccctctggaaacagagggctctgcatccatgtccatgagccttcatgcccatctggccatcaggccttgggaagcagcaccccacagccttggcacagctgcagagacctccttgcgtcaggatggagtcaaacctggaccccctgccattctcatctgcaggaaacactggcctccttcatcctcaggctgtgttgctggaagtcacccatctccgaggccccttgggatcgactgagtgaccagcagtgaagttcatccaccttctgaatggatgccatcatctgacgtgatggagctcagtgggatgttgttgcggtcttccctcccttagctaggatgtccctgataaaggatgacacccaagcctcagcacaactggccaaacttgaggtggtcatctcagcactgatgctgggccaacaattagccccatttgtacatttttacaaatttttggcaattgccaagaattgtccaccttccctccccattgaattaaagaaacttcttgcctcatggatactcaga

SEQ ID NO: 10768 - DNA, 964 bp, Homo sapiens
aacatgtggaccaggaatatgggacccctgaaaacaatatctgcgttggtgttctctaaatattttcaggcatgtctctttcttctgatattttatttctatttaatgtttaagtattttactataattaggtaactttccatttcctggttattgtaccaattaccgtaacgttattaatatattaaattaacatgatgttttccaaaatgtaaattaaactgagagcagaagtgacaaagccctgacataaaacagtgaagcagtgctcttgtttttaccacacaaaggccaattgttttaatctgctgacccacccatgggtgtaaaataagaaacattcactaaatcaagagccacatgcaaactgccaggagctctgctctgctcagggaagataccacatcctagagagcatttgtaagtagtgatttaaatttatggaaatctgcattcattttatagtgtatctggttttggtagaggccagataggttaagtggataggcatataaaaagactaccatcccctgcaactttcaagtgttttgtcatggtagtgatcaattccattccttggagaatgtgattattatttttcaatcattgttgccagtggaggagaatttcacaggcttccccttggttctgctctaataatgtccctgactctacaggtcaggaagaaagtgagagtcctgccagctgccatgtgtgtccattacacattcaagaagaggcaataacggcaaactgattagatccaccttgggatggacatgagtcaaaactctaggtagcatctgaccttcaaaactccctctgcaggctgggtatgatggctcatgcccgcagtccccgcacttttggaggcggaggtgggaatatctcttgaggcccagagttgcagaccaccttgggctacacagtgacagcctgtctgtacaaaaactaaaaaacagaa

SEQ ID NO: 10769 - DNA, 438 bp, Homo sapiens
agtgaaggaagtgggccagtcacttcaaggagaacaattgacagtatttgttgccgatgacaaaatttgaatttactaatgaaaaattggaattttggaaaatctgagtccaccactatggggctaacagtttccgacacttaaaagactttcctgagatgaaatgagcagtgatattaacaaatatggttttttgatgatataaaatgcaatgtcattttcatttttcaaattactagtttaccatttactcaaagtgtaagataacaaatgtaacagggtatgaaagatgactattataggccaggcctggtgactcacacctgcaatcccagcactttgggaggccgtggcaagcggatcgcttgagcccaggagtttgagaccagcctgagcaacatggtgaaaccctgtctctactaaaaatacaaaaattag

SEQ ID NO: 10770 - DNA, 426 bp, Homo sapiens
ggtgcaacgggtacttttatctgacaacttggccaggccaagttgattttcgtcaagcaaacactggtctagatggcgctgtgtaactaacatgtaagcccgtagacttgaagtagaacagtttatccttcataacgtcagtgggcctcatccgatcagatgaggactataagaggaaaaggctgaactcccttgaggaggaggaaattctgcctccagcctgcatccccagctcttccctgggtctccaggatgctggcctgccctcaagatgttagacttgccagcccccaacatcctatgagccagttccttaaaacaaatctctgcatctccctccatcctgttggttctgtttctctagtgaggcctgactagtaactggggggttctagctctggccttatttcctgagagatggggacg

SEQ ID NO: 10771 - DNA, 442 bp, Homo sapiens
gtaacaactataatttattaagagttttctatatgtcagccactattgaaacatttcatatttattatctcatgaacaaacactcattacagcatagtcacacaactggtaattgatggagctaatatttgccccaaatctgggtggttgcagagctggtattcctcatctctgtttatctcctcctgtgccttctgaatatctcctctagcattgaatctgctggactcatgtttaaactgcatgctcaggtaaactgaaaataacatagttatataataactactgtggttaacaagatctgccacccacttattcaacaaatgaaagtgtgtgaatagtataaatatataaatatacatatatgtgtgtaggtaaggccgttatagcagcactctatgtaataactagtttctactgcatttaagaaaccaagacaaag

SEQ ID NO: 10772 - DNA, 373 bp, Homo sapiens
gtggctatccctgccacccaaacagacccttgactctcaagtgtacggggtcccatttacacagggggagagcttacagcctacgttgagtctatacttaccacttagtgagcatggtatccgctcaggggcctctgtgggcatccatctcctctgcagcatctttcctccccaccgctgggcctgcacatgaccccctccttgggttagacctctgatcagtgatgaccttggtatgctggtgatggtcagtcttggcaccaaatgagacagtttatgtcatcagctattcaataaaacactaatctagttgtcaccgtgaaagtattttgtgacattgttatgtacgtgttgttacaaatgtgcatgatgc

SEQ ID NO: 10773 - DNA, 382 bp, Homo sapiens
atagatctatcatatatatatatatcagatatatatatatatgatatacatatatatcagatatatatatatcagaaagggatctgatcagctagtctgtgtccagccctatggcggggtgatttggggtcacattactgcccactcatgagaatcacattgtgagagtagggtagcaatgccggacaggataacatacaggacagcagaataaaaaatctccctctccctgcagaaaattaactacaggctagggttttgctcaccataaccaaaggcattgggggtcaaacacgttactgtgattgctgaattgaatcctttggtcctgtgcatgggtgcactggctcacactcacccatgtgcacatctgtctgtgtag

SEQ ID NO: 10774 - DNA, 536 bp, Homo sapiens
ggtgtctctgtgtctcttcatataaggacaccagtggtattcaattaagggtctgtcctactccagtatgacctcctattaggttaacttattatttccacaatgaccctgtttccaaataaggtcacattctgtggtactgggcattagatctttaacatattttttaaaggaagagggggacatgattcaaaccataacactgcactagggttcttttgatttctttaacctaaagccttagttttaactggacaggtaagtaccttgcccagtcacagatgtaatacatggtagaaataggtgttgactgtatagccacggttcactcttctccaccaggcctctgccagagaaactagtgcaaatgccagcagcaagtgagggtgggaatcttattagaaatttaagataataatgctgtatatatacacatgcctatgtctatatatgaacttacagattatagaacacttattataaggatttagagattatagagcacttttctacccagagcaaaaaaaaaggagaaa

SEQ ID NO: 10775 - DNA, 353 bp, Homo sapiens
ggtgtctctgtgtctcttcatataaggacaccagtggtattcaattaagggtctgtcctactccagtatgacctcctattaggttaacttattatttccacaatgaccctgtttccaaataaggtcacattctgtggtactgggcattagatctttaacatattttttaaaggaagagggggacatgattcaaaccataacactgcactagggttcttttgatttctttaacctaaagccttagttttaactggacaggtaagtaccttgcccagtcacagatgtaatacatggtagagggaagaatttctcaaagacaactgttctaagactcatattagggatcctctagc

SEQ ID NO: 10776 - DNA, 487 bp, Homo sapiens
tcgtcttcattccaagaactctagaatggcacagcacgtttggttttgaaacctgtggaattttagtgctgtccattctcccaagtgtatgcctttagtgaaggtaaaaggaaagactgttttctgtgtcaagggaagattcatatgcaaatcccaagactcagatgttatttcagaagagttggtgtccatagtaaagtagaactggcccaggcttatctgcctgaaagggcaactgtttgaggtagagggaactggcagaataggaggggtggaatcttcctgggagaaagtaaaaagaattctaggtggagaggagatcaagatgtgaaccaaacacatgtcttctaaattactataggaaatgttggaaaggactttagaacaaacaataaatatgtcataggaggaaaacaaagagaagtctttgggccagaaatagaaactgttaaaaacaaaacaacaacaacaaaacataaaaataaaa

SEQ ID NO: 10777 - DNA, 343 bp, Homo sapiens
ccacagaaagagtgtttcgaaactgctgtttcaaaaggaatcttcaactctgtgagttgaatgcaatcatcacaaagaagtttctgacaatgcttctctctcgtctttctgtgaagataaaggaaaaggctttcaggccttttccaccacaggcctgaaagcgctccaaatgtccacttgcagattctgccaaaagaatatttcaaaactgctctatgaaaagcaatgttaaactctgcggctcgaacacaaacatcacaaagcagtttctgagaatgcttcagtttagtttttctgtggaaatattcccgtttccaaagaaatcttcaaagaggtccacgta

SEQ ID NO: 10778 - DNA, 3103 bp, Homo sapiens
ctgtgacagcaggtttgcaaaaccaatgaaaaaaacagttttccccaggcagggaggaattttttttataattaaatactgaaagttggaattcctatgatcatcaaagtcactctcaggaattagaagcaagtttacatgtcatctttattttttgctttagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcggtatttttgatcactgtctggaattttgaactatatatgatccccttggcattgttgctgatctttgtctacaatttcatcagacctgtgaaaggcaaggtcagcagcatccaggacagccaggagagcacagacatagatgacgaggaggatgaagatgacaaggaatctgagaaaaaggggttgattgaaagaatctatatggtacaggatattgtttcaactgttcaaaacgtcttggaggaaatagcttcttttggagaaaggattaagaacacatttaactggacggtccccttcctttcatctctggcctgtttgattctggcagcagccaccatcattttgtatttcattccactgcggtacatcattttaatctggggcataaataaatttactaagaagcttcgaaatccctattccatcgacaataatgagctactagacttcctctctagggtaccgtctgatgttcaaaaggtgcagtatgcagaattgaaactctgcagcagccacagccccctgcggaagaagcgcagcgctctctagggcacacaccgactttggacagcagcacccaatattgtgtttggttgagtagaccaatgttatggctgtttcagtggtacccaaggtgtccttctgaaatgcatgccctgtggcaccctctgtatacttcctcctccttcacgtgcacagacatacacacatgtgcacacaccctcatgcatgggtgtcctagttgcgtagagggtcagcccagcgaaaagcaacaaccccaagactgtgaaagactaacatccattctgaaataggagataacaaggctgccatggatctgaacaccaccttccttgagaacagccaggagcccacttggattcaagagtgactttgaacttgttttcacacctccaacagactctcattaagattcagttatttccgctccccagccccacactcctttcagattatcgttcatgggcgtaagtctcttctcagagttaacaagtctttggtagtcatcctctgtccaaatattgtatattattaaaaggcatttttaataattaccagaattagctcaaacctttagggatctttcagccatgattattaaggatatgtatgtgaatttttgggaaacctctcggtgctggatgccagcctacagcagggtccattgctggcaatggatggcccaggaaggtccctagagatcactcacttgaaaaatgagggtcccatgaaagtatttggttgccttctgatgccacttcttctcactttactttttgcttattttcaaaatattataaaatgtcaacatataatttcagaaaggcaggtgggggtaggggagaaatgaatgaataaattctctaggtatttagaaagataagaaactgaagaccgagagactaataaggctgcttacctaattattataatcatttcatttgcctgaatgttttaagcaggaagtagaaatactttggctgcccaaatgtatcttttgttcctcttagaagtaaaataagctacatacaataaaaatttatttcagaaccccatttctagaaaataccaccccagagtcctcatttgatagcatctgtctcctgcagacctcatcattccacagtatttccctgccatgtaaaaatcctgactttgtgcgtatataaaatgtatgcaattaagtctgtttaaatgatatttaagttttaaagactgtattttgttgacacatactttgtgcagtttttatgtatgtatgtattataaaaaaagttaaggttaaaaacatctcatttaatagtgagttcactatttttttttttttgtctctgggttgtaatttaataatcttcaaacaaaatgtttacgaaaaatgccaaagattctaaatcttaaca

SEQ ID NO: 10779 - DNA, 2154 bp, Homo sapiens
gtcactagccctcaaagtggccattccagttggagatggcatgaacacagagagatgcagcaaaagaacattccaggaagatgtacagtatgctagtaagatcctccgtgtatcgccaagggcgctttctaataacacagtgacagtttgccactggggactcccaagtactcatatttatcacagatgttttagtcattacattgcaaatgaaattaatttccacgagaaatctatataaaagtctggggtccagtatcaatttcagcattttttcctctcaggcaaagtaaatgtgtataattttccgagatgttttccccaagattttagatatttttaaacgaataatcctcagtaagttgctgtatcatatactaagataaacattcccaagaggcttattaagcttacttatggttgaaaactggcacacacaaaacgaacatcatctagcagtgcccagcgaaggtagaaacccacgcatctcattagaaaaatctgcttttaatattttggtttcaagaaatgatgcatgacttctcaaatccttcctgcaattaatccctccatgttcctgtgtttagaaaatgattcattacctttgaaccttccttcctttgccttcggttgtccttggggagccattagcacacactgtggcgagctagggttacctaaccgccagcatcacggctatttgttttcacaggtgcagtatgcagaattgaaactctgcagcagccacagccccctgcggaagaagcgcagcgctctctagggcacacaccgactttggacagcagcacccaatattgtgtttggttgagtagaccaatgttatggctgtttcagtggtacccaaggtgtccttctgaaatgcatgccctgtggcaccctctgtatacttcctcctccttcacgtgcacagacatacacacatgtgcacacaccctcatgcatgggtgtcctagttgcgtagagggtcagcccagcgaaaagcaacaaccccaagactgtgaaagactaacatccattctgaaataggagataacaaggctgccatggatctgaacaccaccttccttgagaacagccaggagcccacttggattcaagagtgactttgaacttgttttcacacctccaacagactctcattaagattcagttatttccgctccccagccccacactcctttcagattatcgttcatgggcgtaagtctcttctcagagttaacaagtctttggtagtcatcctctgtccaaatattgtatattattaaaaggcatttttaataattaccagaattagctcaaacctttagggatctttcagccatgattattaaggatatgtatgtgaatttttgggaaacctctcggtgctggatgccagcctacagcagggtccattgctggcaatggatggcccaggaaggtccctagagatcactcacttgaaaaatgagggtcccatgaaagtatttggttgccttctgatgccacttcttctcactttactttttgcttattttcaaaatattataaaatgtcaacatataatttcagaaaggcaggtgggggtaggggagaaatgaatgaataaattctctaggtatttagaaagataagaaactgaagaccgagagactaataaggctgcttacctaattattataatcatttcatttgcctgaatgttttaagcaggaagtagaaatactttggctgcccaaatgtatcttttgttcctcttagaagtaaaataagctacatacaataaaaatttatttcagaaccccatttctagaaaataccaccccagagtcctcatttgatagcatctgtctcctgcagacctcatcattccacagtatttccctgccatgtaaaaatcctgactttgtgcgtatataaaatgtatgcaattaagtctgtttaaatgatatttaagttttaaagactgtattttgttgacacatactttgtgcagtttttatgtatgtatgtattataaaaaaagttaaggttaaaaacatctcatttaatagtgagttcactatttttttttttttgtctctgggttgtaatttaataatcttcaaacaaaatgtttacgaaaaatgccaaagattctaaatcttaaca

SEQ ID NO: 10780 - DNA, 2980 bp, Homo sapiens
ctgtgacagcaggtttgcaaaaccaatgaaaaaaacagttttccccaggcagggaggaattttttttataattaaatactgaaagttggaattcctatgatcatcaaagtcactctcaggaattagaagcaagtttacatgtcatctttattttttgctttagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcggagagcacagacatagatgacgaggaggatgaagatgacaaggaatctgagaaaaaggggttgattgaaagaatctatatggtacaggatattgtttcaactgttcaaaacgtcttggaggaaatagcttcttttggagaaaggattaagaacacatttaactggacggtccccttcctttcatctctggcctgtttgattctggcagcagccaccatcattttgtatttcattccactgcggtacatcattttaatctggggcataaataaatttactaagaagcttcgaaatccctattccatcgacaataatgagctactagacttcctctctagggtaccgtctgatgttcaaaaggtgcagtatgcagaattgaaactctgcagcagccacagccccctgcggaagaagcgcagcgctctctagggcacacaccgactttggacagcagcacccaatattgtgtttggttgagtagaccaatgttatggctgtttcagtggtacccaaggtgtccttctgaaatgcatgccctgtggcaccctctgtatacttcctcctccttcacgtgcacagacatacacacatgtgcacacaccctcatgcatgggtgtcctagttgcgtagagggtcagcccagcgaaaagcaacaaccccaagactgtgaaagactaacatccattctgaaataggagataacaaggctgccatggatctgaacaccaccttccttgagaacagccaggagcccacttggattcaagagtgactttgaacttgttttcacacctccaacagactctcattaagattcagttatttccgctccccagccccacactcctttcagattatcgttcatgggcgtaagtctcttctcagagttaacaagtctttggtagtcatcctctgtccaaatattgtatattattaaaaggcatttttaataattaccagaattagctcaaacctttagggatctttcagccatgattattaaggatatgtatgtgaatttttgggaaacctctcggtgctggatgccagcctacagcagggtccattgctggcaatggatggcccaggaaggtccctagagatcactcacttgaaaaatgagggtcccatgaaagtatttggttgccttctgatgccacttcttctcactttactttttgcttattttcaaaatattataaaatgtcaacatataatttcagaaaggcaggtgggggtaggggagaaatgaatgaataaattctctaggtatttagaaagataagaaactgaagaccgagagactaataaggctgcttacctaattattataatcatttcatttgcctgaatgttttaagcaggaagtagaaatactttggctgcccaaatgtatcttttgttcctcttagaagtaaaataagctacatacaataaaaatttatttcagaaccccatttctagaaaataccaccccagagtcctcatttgatagcatctgtctcctgcagacctcatcattccacagtatttccctgccatgtaaaaatcctgactttgtgcgtatataaaatgtatgcaattaagtctgtttaaatgatatttaagttttaaagactgtattttgttgacacatactttgtgcagtttttatgtatgtatgtattataaaaaaagttaaggttaaaaacatctcatttaatagtgagttcactatttttttttttttgtctctgggttgtaatttaataatcttcaaacaaaatgtttacgaaaaatgccaaagattctaaatcttaaca

SEQ ID NO: 10781 - DNA, 3049 bp, Homo sapiens
ctgtgacagcaggtttgcaaaaccaatgaaaaaaacagttttccccaggcagggaggaattttttttataattaaatactgaaagttggaattcctatgatcatcaaagtcactctcaggaattagaagcaagtttacatgtcatctttattttttgctttagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcggtatttttgatcactgtctggaattttgaactatatatgatccccttggcattgttgctgatctttgtctacaatttcatcagacctgtgaaaggcaaggtcagcagcatccaggacagccaggagagcacagacatagatgacgaggaggatgaagatgacaaggaatctgagaaaaaggggttgattgaaagaatctatatggtacaggatattgtttcaactgttcaaaacgtcttggaggaaatagcttcttttggagaaaggattaagaacacatttaactggacggtccccttcctttcatctctggcctgtttgattctggcagcagccaccatcattttgtatttcattccactgcggtacatcattttaatctggggcataaataaatttactaagaagcttcgaaatccctattccatcgacaataatgagctactagacttcctctctagggtaccgtctgatgttcaaaaggtgcagtatgcagaattgaaactctgcagcagccacagccccctgcggaagaagcgcagcgctctctagggcacacaccgactttggacagcagcacccaatattgtgtttggttgagtagaccaatgttatggctgtttcagtggtacccaaggtgtccttctgaaatgcatgccctgtggcaccctctgtatacttcctcctccttcacgtgcacagacatacacacatgtgcacacaccctcatgcatgggtgtcctagttgcgtagagggtcagcccagcgtaacaaggctgccatggatctgaacaccaccttccttgagaacagccaggagcccacttggattcaagagtgactttgaacttgttttcacacctccaacagactctcattaagattcagttatttccgctccccagccccacactcctttcagattatcgttcatgggcgtaagtctcttctcagagttaacaagtctttggtagtcatcctctgtccaaatattgtatattattaaaaggcatttttaataattaccagaattagctcaaacctttagggatctttcagccatgattattaaggatatgtatgtgaatttttgggaaacctctcggtgctggatgccagcctacagcagggtccattgctggcaatggatggcccaggaaggtccctagagatcactcacttgaaaaatgagggtcccatgaaagtatttggttgccttctgatgccacttcttctcactttactttttgcttattttcaaaatattataaaatgtcaacatataatttcagaaaggcaggtgggggtaggggagaaatgaatgaataaattctctaggtatttagaaagataagaaactgaagaccgagagactaataaggctgcttacctaattattataatcatttcatttgcctgaatgttttaagcaggaagtagaaatactttggctgcccaaatgtatcttttgttcctcttagaagtaaaataagctacatacaataaaaatttatttcagaaccccatttctagaaaataccaccccagagtcctcatttgatagcatctgtctcctgcagacctcatcattccacagtatttccctgccatgtaaaaatcctgactttgtgcgtatataaaatgtatgcaattaagtctgtttaaatgatatttaagttttaaagactgtattttgttgacacatactttgtgcagtttttatgtatgtatgtattataaaaaaagttaaggttaaaaacatctcatttaatagtgagttcactatttttttttttttgtctctgggttgtaatttaataatcttcaaacaaaatgtttacgaaaaatgccaaagattctaaatcttaaca

SEQ ID NO: 10782 - DNA, 387 bp, Homo sapiens
tgccactggacagctgtctgggggctctccttatgttggtcacacttacaccctgtgcgggggtctccgtctctgatctgtgtgtctgccccttagcagacctcagcgaaagaaagcagattacccagcgatatgtgagtgtttttccttattgtacactccccctcctcccaccttctcttttaaaacaaagtctttattgaaacaaagtctctgaattgaaaaactacatcaaaagagatctttgtcccaagtttccttgtacgtcataaaacaagacatcagacttaggggttaatgcattagtgaaaaggtgacagtagaattaagagttggttttgctattttgaaaggcaaaaagagattctgaatttttagcgtttagca

SEQ ID NO: 10783 - DNA, 422 bp, Homo sapiens
ttggcctatgacaagctgtctcccaaagacaaccgtgattagaaagccagagcaaaggcaaaatatttccacccaagtacttctttaaaaatgaaatgtcatagaccatatcttcaaatgcatttaagaagtttcccagctatatcttgatattttgctacaatggattattgtcatataacccttaatattgggacagtggtgcctgttgtacttatttgtttcaataaattttgtttcctcattgtttgttacaggaagttcaatttgaatttcttcatcagcattataatcaatcttattgtaattaactcaacaagtatgaaagaattggcagattctgttggaattaggaaaaatgcatctgttttcttccttttatgggctgtgatagtaaaataaatggtgattatatccggaaa

SEQ ID NO: 10784 - DNA, 606 bp, Homo sapiens
ataaatttcccaaaataaattatttggtcttaaattacaaaaacaaacaaaccagaaaatgtgttttggctgggcacggtggctcaaacctgtaatcccagcactttgggaggccaaggtggatggatcacctgaggtcaggagttcaagaccagcctggccaacaaggtgaaaccctgtctctactaaaatacaaaaattagccgggcatgatggcgggtgcctgtaatcccagctactcgggaggctgagatgggagaatcacttgaacccaggagatggtggttgtggtgagccaagatcatgccactgcactccagcctgggtggctgagggagactccgtcaaaaaaaaaaaagaaaagaaaagaaaagaaaaaagaaaatgtgttttcacatagaaaatataagggcaaatgcaaattaaaaataagaggttcaatttactctggtgaaaacaggagaagagatttccctcccctcctttttctcaggacatttaccttagaaaacttgtaagtattttctcttttctttgaaatacatatgtatatataggcttttgaagactaggcaggacttttgccaactggccttttctcagctc

SEQ ID NO: 10785 - DNA, 796 bp, Homo sapiens
ggacaagcagtgcatgagcagcagctcagagaatgaaaaccctcctttcattttcatcaggggctgcatggttatccctctcagtgcaatatagctaaaggggcttgaaatgctgggagtagtcttaaacagcccattcttgaaaggttttcattaactcactctaaacatctaaattaaaaatgtttttgttttcactatagtaaacaggagtgtaacattgcaggtttggtacatttctgaatgcctctccacacactgaagcacaagagccactgaaaaaagctatatgataaatattttaaaaattatttatctgtgttgcattacatgaggccttatctcccagacacttaataaaagagctaatgagaagaagagctaaattctaagattttgatgtttggtcattaaacattacagacaccagtgatcagagaaaaaaacagaagaaataatgagaaagtgacataaaaaattttaaatgcagcaagatatatcagaatcacgatatctggccttttatttatctatcggctcactactactactacgcacacaatttatcacttaaaagaaaaatacataatgttgttagaatttatcagcagtaatgctccaagctctatctttctacaaaaatttcatatcagtaggtttgcttgaggattctagatttggtaagattgcagtttgcacagagaaaaagatatcaatatcaataggaaaatattcttttagaatttctccatggagctgacaacatcttagaatgtatcgtcctagacagagacta

SEQ ID NO: 10786 - DNA, 814 bp, Homo sapiens
actccaggcaacaagcaacatctagggaatgtgcttttaggtagggtcagcataatatcccactctgggagacatttttattttaaagttgtagagggtgatgctgctggcggctccctcccaatcagcaccatttgcagcctcttttgaagacagagaactgagggctgtccttcgagtggagcagtgtgattccaaaaaaagagatgctccttgtggtcctgggaccagggataggactccagttgagcctggtggaagaggtcctcatcctagcccaacggagagccatgcagctgagcttgggcgatgtggtccacgtggttgtttctgagtgtgtcctgaggttcctggatggcttgcagttccctatgcagatccaatgcattttttgcttttttgcttctacaacctggaatttatatgttcaagatggagccatctcagccatgacaacagagaatgtaccactctcacgtgaggaagaggggtaggcagtgctcctgtatcaccagctgttaatgagaccctgaggaaaccacatcatggagatcagcccttctctcctgtaaggaactcatcctatgaaagagcaattggtggctgcaagagctgtctctgggacagctgttcatgtctatatctgcagggtaaccctcatagtcatatgcagtcatatccatagtcatatctggagtcagtctccagtttgactgagtgaatggagaaactaaacatttattactgaataataacattaataaaccatcttaatgatagtaataataaacatattgatgagtattaacaggaa

SEQ ID NO: 10787 - DNA, 797 bp, Homo sapiens
agcggctcccgcggcgggccgggtctccagggaggacctgagtttttcttcacccatggtcagggaggcgccatcgccctggctttggggctggggcctccggggaggttccggtaggggcgttggagaggccgctctttttgcaaggcccgagatggcgggccctgcgcaggccgccctattccgcgccctcagggcgtcagtatccgcctgaggccggatacccactctgggctcggatacccgcgctgggcccggagcatcctcggcgctgccctcccagagccccgcagaggctgaggtggcgcgggggcggccccggctccgcgagaagaggcggcagcgagggctggaggacccgggctacggggctccggggcgtctggcctgggtgggactgagcccatccagggactgggactccggggttctggtgtaggtggatccggggcaggctcaggaccaagaccctctccttccaccaaggagcgcccagaggccggcgggagctccaggttcacctcctcctcctccaggggacgacttgagaaggcatcctgaccctatgcagaaatgcagaaacacttccatgagctaaacaacctatgtgaaggcctgaaagccaaagcaagatcctcttattacaaagctgtccaacaaaaagttttccaagtaacactggaggtccatcactcactcttcctggtctggaaatgccagaaatgtcctccttggtccttctgagagtcaagatcttttcaaagtcacctcaggagccacagaaccactccatccta

SEQ ID NO: 10788 - DNA, 452 bp, Homo sapiens
gcctactactactaaattcgcggccgcgtcgacggccagttatccaggcagtgactttctgtacagctacagtcacctctggacacctgcggagactttaaaaatttccagaaggtcaggaatttttggagacctttcttatggctacgttgcctgcaaaggtgaatcaataagcttctgaactgacttagaaaatgttgcagagactcttgtgaacagatagaccctctcctgccactccagatagacgtatccgggtcacacacacctgatttaacaacatctcattatctcaggtgagcaacagacagcaatttaggacctatcccagtgtggatgagagatattgagttggcttagaaaaatgttagatagactagatggggcaagaaagcccattctggggctcaaaagcctgcacatagagttgctggcacataaagggtatgtat

SEQ ID NO: 10789 - DNA, 347 bp, Homo sapiens
aaaatacaactgcttcctgtggtcattatcttttatcacaggccatttccaatccagaggaagaccttctagaagaagtgatgggtgggagagtgctgacatactatgtgaagctactatttggagttggacacgagtgcatgtgaccttgtgccacagcgggaatgtgagctggatgacaaatggagatttggacttgtgataattggcctctgtgtcattgtgtggaagactgactggtccctttatttcctgtagcttgactaccacacaaattaatccactcaaatgttggcaagtggagcagagtcccaggacaggtaaggcactttccctgctttttctta

SEQ ID NO: 10790 - DNA, 1693 bp, Homo sapiens
agcggctcccgcggcgggccgggtctccagggaggacctgagtttttcttcacccatggtcagggaggcgccatcgccctggctttggggctggggcctccggggaggttccggtaggggcgttggagaggccgctctttttgcaaggcccgagatggcgggccctgcgcaggccgccctattccgcgccctcagggcgtcagtatccgcctgaggccggatacccactctgggctcggatacccgcgctgggcccggagcatcctcggcgctgccctcccagagccccgcagaggctgaggtggcgcgggggcggccccggctccgcgagaagaggcggcagcgagggctggaggacccgggctacggggctccggggcgtctggcctgggtgggactgagcccatccagggactgggactccggggttctggtgtaggtggatccggggcaggctcaggaccaagaccctctccttccaccaaggagcgcccagaggccggcgggagctccaggttcacctcctcctcctccaggaaatcccacttccagctggatgtctggatgaactactgaaagctgctgagtgtcctgcagcaggtgagctgtggccagagcccaaggatgaaggggactccctcactctgtgactgtgaacgaggaagcctgaggtgtagcaggcccaggccccagaagtatggaacaaaatgaggccatttccaatccagaggaagaccttctagaagaagtgatgggtgggagagtgctgacatactatgtgaagctactatttggagttggacacgagtgcatgtgaccttgtgccacagcgggaatcttgactaccacacaaattaatccactcaaatgttggcaagtggagcagagtcccaggacaggtacagaaacacccccagttcaaggatcttcacacctggatttaggcctacacctgcaactaccccagttgtagagggtgatgctgctggcggctccctcccaatcagcaccatttgcagcctcttttgaagacagagaactgagggctgtccttcgagtggagcagtgtgattccaaaaaaagagatgctccttgtggtcctgggaccagggataggactccagttgagcctggtggaagaggtcctcatcctagcccaacggagagccatgcagctgagcttgggcgatgtggtccacgtggttgtttctgagtgtgtcctgaggttcctggatggcttgcagttccctatgcagatccaatgcattttttgcttttttgcttctacaacctggaatttatatgttcaagatggagccatctcagccatgacaacagagaatgtaccactctcacgtgaggaagaggggtaggcagtgctcctgtatcaccagctgttaatgagaccctgaggaaaccacatcatggagatcagcccttctctcctgtaaggaactcatcctatgaaagagcaattggtggctgcaagagctgtctctgggacagctgttcatgtctatatctgcagggtaaccctcatagtcatatgcagtcatatccatagtcatatctggagtcagtctccagtttgactgagtgaatggagaaactaaacatttattactgaataataacattaataaaccatcttaatgatagtaataataaacatattgatgagtattaacaggaa

SEQ ID NO: 10791 - DNA, 1570 bp, Homo sapiens
agcggctcccgcggcgggccgggtctccagggaggacctgagtttttcttcacccatggtcagggaggcgccatcgccctggctttggggctggggcctccggggaggttccggtaggggcgttggagaggccgctctttttgcaaggcccgagatggcgggccctgcgcaggccgccctattccgcgccctcagggcgtcagtatccgcctgaggccggatacccactctgggctcggatacccgcgctgggcccggagcatcctcggcgctgccctcccagagccccgcagaggctgaggtggcgcgggggcggccccggctccgcgagaagaggcggcagcgagggctggaggacccgggctacggggctccggggcgtctggcctgggtgggactgagcccatccagggactgggactccggggttctggtgtaggtggatccggggcaggctcaggaccaagaccctctccttccaccaaggagcgcccagaggccggcgggagctccaggttcacctcctcctcctccaggaaatcccacttccagctggatgtctggatgaactactgaaagctgctgagtgtcctgcagcaggtgagctgtggccagagcccaaggatgaaggggactccctcactctgtgactgtgaacgaggaagcctgaggtgtagcaggcccaggccccagaagtatggaacaaaatgaggccatttccaatccagaggaagaccttctagaagaagtgatgggtgggagagtgctgacatactatgtgaagctactatttggagttggacacgagtgcatgtgaccttgtgccacagcgggaatgtgagctggatgacaaatggagatttggacttgtgataattggcctctgtgtcattgtgtggaagactgactggtccctttatttcctgtagcttgactaccacacaaattaatccactcaaatgttggcaagtggagcagagtcccaggacaggtacagaaacacccccagttcaaggatcttcacacctggatttaggcctacacctgcaactaccccaggccagttatccaggcagtgactttctgtacagctacagtcacctctggacacctgcggagactttaaaaatttccagaaggtcaggaatttttggagacctttcttatggctacgttgcctgcaaaggtgaatcaataagcttctgaactgacttagaaaatgttgcagagactcttgtgaacagatagaccctctcctgccactccagatagacgtatccgggtcacacacacctgatttaacaacatctcattatctcagatgctgtaaaggactgtcagtaggccttcagccaggaggtggtgcttccaaaagactgccagctgtggtggtagtggcaccaatttgatcttctactactttgcagacatctcttctgcaaacaccagacaaactgagacaatgaacttccgcaggacccaaagcacctcttactgcaggaaagaagatccagtgagatagttagtccacaaatggaatgtcaatccataaacacacttaagtaacaga

SEQ ID NO: 10792 - DNA, 1441 bp, Homo sapiens
agcggctcccgcggcgggccgggtctccagggaggacctgagtttttcttcacccatggtcagggaggcgccatcgccctggctttggggctggggcctccggggaggttccggtaggggcgttggagaggccgctctttttgcaaggcccgagatggcgggccctgcgcaggccgccctattccgcgccctcagggcgtcagtatccgcctgaggccggatacccactctgggctcggatacccgcgctgggcccggagcatcctcggcgctgccctcccagagccccgcagaggctgaggtggcgcgggggcggccccggctccgcgagaagaggcggcagcgagggctggaggacccgggctacggggctccggggcgtctggcctgggtgggactgagcccatccagggactgggactccggggttctggtgtaggtggatccggggcaggctcaggaccaagaccctctccttccaccaaggagcgcccagaggccggcgggagctccaggttcacctcctcctcctccaggaaatcccacttccagctggatgtctggatgaactactgaaagctgctgagtgtcctgcagcaggtgagctgtggccagagcccaaggatgaaggggactccctcactctgtgactgtgaacgaggaagcctgaggtgtagcaggcccaggccccagaagtatggaacaaaatgaggccatttccaatccagaggaagaccttctagaagaagtgatgggtgggagagtgctgacatactatgtgaagctactatttggagttggacacgagtgcatgtgaccttgtgccacagcgggaatgtgagctggatgacaaatggagatttggacttgtgataattggcctctgtgtcattgtgtggaagactgactggtccctttatttcctgtagcttgactaccacacaaattaatccactcaaatgttggcaagtggagcagagtcccaggacaggtacagaaacacccccagttcaaggatcttcacacctggatttaggcctacacctgcaactaccccagatggagccatctcagccatgacaacagagaatgtaccactctcacgtgaggaagaggggtaggcagtgctcctgtatcaccagctgttaatgagaccctgaggaaaccacatcatggagatcagcccttctctcctgtaaggaactcatcctatgaaagagcaattggtggctgcaagagctgtctctgggacagctgttcatgtctatatctgcagggtaaccctcatagtcatatgcagtcatatccatagtcatatctggagtcagtctccagtttgactgagtgaatggagaaactaaacatttattactgaataataacattaataaaccatcttaatgatagtaataataaacatattgatgagtattaacaggaa

SEQ ID NO: 10793 - DNA, 1458 bp, Homo sapiens
agcggctcccgcggcgggccgggtctccagggaggacctgagtttttcttcacccatggtcagggaggcgccatcgccctggctttggggctggggcctccggggaggttccggtaggggcgttggagaggccgctctttttgcaaggcccgagatggcgggccctgcgcaggccgccctattccgcgccctcagggcgtcagtatccgcctgaggccggatacccactctgggctcggatacccgcgctgggcccggagcatcctcggcgctgccctcccagagccccgcagaggctgaggtggcgcgggggcggccccggctccgcgagaagaggcggcagcgagggctggaggacccgggctacggggctccggggcgtctggcctgggtgggactgagcccatccagggactgggactccggggttctggtgtaggtggatccggggcaggctcaggaccaagaccctctccttccaccaaggagcgcccagaggccggcgggagctccaggttcacctcctcctcctccaggaaatcccacttccagctggatgtctggatgaactactgaaagctgctgagtgtcctgcagcaggccatttccaatccagaggaagaccttctagaagaagtgatgggtgggagagtgctgacatactatgtgaagctactatttggagttggacacgagtgcatgtgaccttgtgccacagcgggaatgtgagctggatgacaaatggagatttggacttgtgataattggcctctgtgtcattgtgtggaagactgactggtccctttatttcctgtagcttgactaccacacaaattaatccactcaaatgttggcaagtggagcagagtcccaggacaggtacagaaacacccccagttcaaggatcttcacacctggatttaggcctacacctgcaactaccccaggccagttatccaggcagtgactttctgtacagctacagtcacctctggacacctgcggagactttaaaaatttccagaaggtcaggaatttttggagacctttcttatggctacgttgcctgcaaaggtgaatcaataagcttctgaactgacttagaaaatgttgcagagactcttgtgaacagatagaccctctcctgccactccagatagacgtatccgggtcacacacacctgatttaacaacatctcattatctcagatgctgtaaaggactgtcagtaggccttcagccaggaggtggtgcttccaaaagactgccagctgtggtggtagtggcaccaatttgatcttctactactttgcagacatctcttctgcaaacaccagacaaactgagacaatgaacttccgcaggacccaaagcacctcttactgcaggaaagaagatccagtgagatagttagtccacaaatggaatgtcaatccataaacacacttaagtaacaga

SEQ ID NO: 10794 - DNA, 790 bp, Homo sapiens
  misc_feature (1)..(1): n is a, c, g, or t
nagggctccatgaatttggcacgttcacacatgctgcccagcagcagagctcatgacaagcagtaaaccccagtgaaaggacctggctgcccttctgccatctgctctcccatggcctctcttgactggtacatctaggcactggagtaaccttcactggctataggagggcataatcctcagtattctcccacctgcaagaaagacaaaaattacctgaataccatggcttctgggtatccttagtgggcttagcgtatttttcatttgctttaacaggccagttatccaggcagtgactttctgtacagctacagtcacctctggacacctgcggagactttaaaaatttccagaaggtcaggaatttttggagacctttcttatggctacgttgcctgcaaaggtgaatcaataagcttctgaactgacttagaaaatgttgcagagactcttgtgaacagatagaccctctcctgccactccagatagacgtatccgggtcacacacacctgatttaacaacatctcattatctcagatgctgtaaaggactgtcagtaggccttcagccaggaggtggtgcttccaaaagactgccagctgtggtggtagtggcaccaatttgatcttctactactttgcagacatctcttctgcaaacaccagacaaactgagacaatgaacttccgcaggacccaaagcacctcttactgcaggaaagaagatccagtgagatagttagtccacaaatggaatgtcaatccataaacacacttaagtaacaga

SEQ ID NO: 10795 - DNA, 607 bp, Homo sapiens
tacctttcccagtctgcaatctctacaggtacagaaacacccccagttcaaggatcttcacacctggatttaggcctacacctgcaactaccccaggccagttatccaggcagtgactttctgtacagctacagtcacctctggacacctgcggagactttaaaaatttccagaaggtcaggaatttttggagacctttcttatggctacgttgcctgcaaaggtgaatcaataagcttctgaactgacttagaaaatgttgcagagactcttgtgaacagatagaccctctcctgccactccagatagacgtatccgggtcacacacacctgatttaacaacatctcattatctcagatgctgtaaaggactgtcagtaggccttcagccaggaggtggtgcttccaaaagactgccagctgtggtggtagtggcaccaatttgatcttctactactttgcagacatctcttctgcaaacaccagacaaactgagacaatgaacttccgcaggacccaaagcacctcttactgcaggaaagaagatccagtgagatagttagtccacaaatggaatgtcaatccataaacacacttaagtaacaga

SEQ ID NO: 10796 - DNA, 844 bp, Homo sapiens
agggaggcgccatcgccctggctttggggctggggcctccggggaggttccggtaggggcgttggagaggccgctctttttgcaaggcccgagatggcgggccctgcgcaggccgccctattccgcgccctcagggcgtcagtatccgcctgaggccggatacccactctgggctcggatacccgcgctgggcccggagcatcctcggcgctgccctcccagagccccgcagaggctgaggtggcgcgggggcggccccggctccgcgagaagaggcggcagcgagggctggaggacccgggctacggggctccggggcgtctggcctgggtgggactgagcccatccagggactgggactccggggttctggtgtaggtggatccggggcaggctcaggaccaagaccctctccttccaccaaggagcgcccagaggccggcgggagctccaggttcacctcctcctcctccagggtgtttacttttcctttatttctgtgaggccagaaattgtcgccatccttcacatcggtgaatcgggaccctaacactcattacctcaggtttattgttattgccattaacagtgttggtggcattatcactaagatcatcattgttgttattattgtcatttatgattattagcaggtgtgttcattttgtctcactatgcattttttttttttttgggggggattggttttgtatgacgttgaattgagcttctttaatcttgaccagtgctgtcagatttctgaagagcattccggaggacaactcctgtctttcagcacagccacagaatttcgtgggcacaggagagcacttagaatattccc

SEQ ID NO: 10797 - DNA, 638 bp, Homo sapiens
aaatccaacagacgaccaacaatagctggggacatgctcaagacccacagagcaagtgcatgaagccagggcaaggggcagcagtgaggacaaatctctccatgagtactgtgggtcttagcctcaactcactaaaaggcctctagagacaataattaaaataaccagtggctcctcgaggaatggaggctaaggagcaaactgccaaacttattctggctggaattggtggctgttttctatggaacacacaagactcaagaatggccaatgaccactctcactggggggttgcagttggcaactggagggatgctcatatttaactgacttagaattggcttgtgtttagcttggcatgatggtattcccattgtttagtatttcaatttcaacatcaaaataaaggctggataagggtgaatgaggaggtagctgcctcacccaagacaagtcttcatttgaaagggtggctaattacattttccttaatttacaaattgtatttgacccactgtgtatttctttaaagttcgcacagagtttggggtattcattttcagaagagaaacgttatggatctgccttcaccctaaatccctaaatcagccagagttcctgagatgaccagggcaggc

SEQ ID NO: 10798 - DNA, 226 bp, Homo sapiens
aaatccaacagacgaccaacaatagctggggacatgctcaagacccacagagcaagtgcatgaagccagggcaaggggcagcagtgaggacaaatctctccatgagtactgtgggtctggtggaacccctcgctgtgcactggttgcctcacctcattggtattagtggagcttgcattttcccctgctctggaatcaccttcccagctctgatacactcctcata

SEQ ID NO: 10799 - DNA, 428 bp, Homo sapiens
  misc_feature (6)..(6): n is a, c, g, or t
  misc_feature (37)..(37): n is a, c, g, or t
  misc_feature (44)..(44): n is a, c, g, or t
ccccgnttttccaacattaaggcccccacccgtaacnagcggcnagggaaccccaattccggggcccaaaatccacctttaaatttattattttttttccaaccctcagccttttaacctttgcccctgattttccccttcccattttattttcacttccattttaagctggctcaaagccttttaggaacaataagttactgaattatatgaacctatttgaggtaatgatgatgccctgggaaggagcagtattgctggatcagaattcactttttccaagttacagattttaataaaccactgtgcaaagcattaggataaatttttattgaaaattgagtgaatgactgaacaaatcgctgggtaatgctgtttaggttgttctattttccacggattaaattaaattctatgtaaaaaaaaaa

SEQ ID NO: 10800 - DNA, 362 bp, Homo sapiens
gtccctccaagctgtagggacaccccagctgggccaggtttctcccagtagaaaatggtctgggaaccagggcctgggtgtggtggctcacacctgtaatcccagagctttgggaggctgagctggaaggactgcttgaggccaggagctcaagaccagtgtgggcaacacagggagaccctatctctacaaaaaacacaaaaattagccaggcgtggtggcgtactcctgtagtctgggaggctgaggattgcttgatcccatgtatttgagactgcagttagccatgactggaccacagcactccagcctgggtgatagagcaagaccctgtctcttaataaaaaaaaaaaaaaatagag

SEQ ID NO: 10801 - DNA, 236 bp, Homo sapiens
ggtcgacctctaaccagggacagtccctctgttaagaagactcactctctttttcccttccattttctcaaaattagttttgcttatagtagttaagaaattatcaaattactttatcaatttgaaatcaatacatataaaaacagttaattgattcatttgattgttgagttcaatactacatgctaaaatatatgaataaagaaaagttgagttttctaatttggtcagatgga

SEQ ID NO: 10802 - DNA, 336 bp, Homo sapiens
tgggatggccagtttgatgtgtcagcttacctatgtgacagttccagttattcaatcaaacactaatcagtgtgttgatgtgagggtatttcgtagatgtgattaaagtccataatcagttgactttgaggaagggagattgttctagacagtttgggtgggcctgactctatcagctgaaaggccttaggagcagagatgaggcttctctgaggaagaaaaaaactgcacctatggacagctgcttcagcccatgcctgagattccagcttgctctttctgacctgcctagccaggccacataagccaattctttgcaataaatcttatattata

SEQ ID NO: 10803 - DNA, 653 bp, Homo sapiens
agcacttaccaattattaaatcatttaaacagtcaggaaatggatactactgtgttctagaaatgggtaccaactctcaaaatgtttcacatactcatggaaataacatggctttaatggaagggcttagggagttctgcttcaagctggctgatcagaaaaaggagaagcctcagaaaggaagtgggatctgtacatgcacccaggaagcacagctttagtgtcaatggagaagtttcgaatagcaaaattctccactgaacttgctgaaagcacgagaggagaaagaagcatttgcaggcccagatgatacctaagagaggactgtgcattgcttttcaacctccacatgtcagtactcaagggataagctgaattttaaaaatttacttttttttttttttcattgtatattactacctgttcactatagctaattgggaaacttacaaaaattagaaataataagattcctctttccccaaagtcaccactatcctgaattttaaaactagagcttacttttgcaatcttgacactttatttcactaccgtcatatagtatccttctgtgtctcagtcctttttctttttttgacattgttatgaagttcatccatgttgttgcatgggctaaggctcataacaatgtc

SEQ ID NO: 10804 - DNA, 380 bp, Homo sapiens
gaaccaggctggtcttgaactgctgacctcgtgatctgcccatctcagcctcccaaagtgctgggattacaggtgtgagccaccacgtccggccagaattcttaacattctttaaaattaggttgtttgaggctttgccctttaaaagtttattatttcccaaaccaaggacatggagaattataaagtctttgaagaccttagtggaaagtactgtataaccaccattttatttagtagatgttattagcaaatatgtgcatgcagcttctctttaggcagatcctttacagagaaacactacattagccaatcaagtgtcattttgtcacagagtacatttaaatacttacagcgtgaacaggtaatcagatgaaaat

SEQ ID NO: 10805 - DNA, 349 bp, Homo sapiens
caagctccgcctcccgggtttacttacgccattctcctgcctcagcctcccaagtagctgggactacaggcgcccccgccaccacacctggctaatttttttttttttgtatttttagtagagatggggtttcactgtgttagccaggatggtctcgaactcctgacctcgtgatccacccaaatcagcctcccaaagtggtgggattacaggcgtgagccaccgtgcctggccggaagggagactttttgatatgctgagtgtaaggctgaggttttgtaaagggacaggggacatagcctggcctcgtccttgtggttgatctccccgactctcacagccagtggag

SEQ ID NO: 10806 - DNA, 628 bp, Homo sapiens
gcaattcgggacctgattttgcagctggactacccctatactcagggatcccaggattcagcacttttgcaactactagagatcagagaccgtgtaaataaactctccccacctggtcagcgtcgtctagatcttttctcttgcttgcttcgtcatagactcaagctgtctactagtgaggtggtgaggatccaatctgctctgcaggcgtttaatgccaaattgccaaacacaatggattatgacacgaccaaattatgtagttaaccataaatgtcaagcacaacccaaaatcttgaaggagtttttacagtgcttttgtggaacagtttatgtttggaagagtaaatttaaattgtcttttcaatatctgtcttatatcagtcaataacattggatggcaatttacacacatgaacttgctgacaatgaatatattatacagcagttttggtttatgaatgacataaatactgacaccagtctagaagacattctactttttacaataaatttcatttgtaattttatatgttccgtggcaatgcttttgtgcattacatcctctagagggaacataaaaagataccaataaaattttgtagctgaacagttattaaaaagaaat

SEQ ID NO: 10807 - DNA, 460 bp, Homo sapiens
aagccagaagtcataaaggaaaaggttgataaattagaatagataaaaatgtaaaacttttgtataatataagacacaaagaatgaatttaaagacatacaatgaaggttaggaagatgaagatgttttggcgatgagtggtggttacacatcagtattaatgtacttaatgttactgaactgtacacttaaaatgatgaaaatggtaatttttatgttatgtgtatttcatcacataaaaaaagacatgaaatgaatcggggaaaatatttgctacataactaagaatgaaggcccttaataaaatctgtaaaactatacacacttttaggaatgaatcaacaaataatttctatgaattagaaaaaagtgacaatccaactaaaaaatgaataagggatataagcaatgtgtttcacagaaaaaataaaaattgacaatgaagttatgaaaaaatgtt

SEQ ID NO: 10808 - DNA, 729 bp, Homo sapiens
atgcctctttggtttcatcctgggataccatttgatgtgcaattaataacagtgtgtttctatgacctaaagtcaactacattttgaaagtcttcaatttgagttttaaaacatggatgagtataaggtcattacttaatttaatgaaagctgctgtaacaaacaaaccaaaatgtgtacattgactcaaccatctctcacatgaagtctaagtgatggtgctgctccttttgattcagtggcccgtattccttccaccttcttgcgctgctgtcttctccatatggtttccaaggccactttgctcaattttattccttttccctgtagggtaaaaagcagggagaatcacatgcaatagattcctatgggtcagatctggatgtgttgcacatcattgccttttgcattccactggctagaactcagacaacggacaatcatgacaggggaggctgaaaaattgaatataacttggtcttaggacgaggaggaatgggtgggcacctgtactctctttcacaatgatgaccctctaaaataattttgatgattcttcagttggcactgtaaggggtgttttgcttatgttctgtgaaaggaagagttgataatcaggcagtgtttcgaggaactttaattcctacattcaagtacaaaggaataaatatatcatccctacaattcattctatgtactgactgttctctgtacctgactagctttgca

SEQ ID NO: 10809 - DNA, 408 bp, Homo sapiens
gttatttactgaagaaaaatgaaagcatgtgtccatacaaacactattatctggatgcctatagcatctttactggtaaaagctaaacgctaaaaaacaacctaaatgtccatcaacaagatgaacggattaaaaaattgtggtatacccaatcaatggggtaatacttagcaataaaaaggaatgaactattgatacacataacatgcatgaatcttagaacaattatgctgaatgaaagatgccaaaaagagtatatagtaaatgatttcatttatatgaaattctagaactgtgtggtgcaatgtagaaggtaccagtcacgtggctgctgactacttgataggtgggctagtgcaaaagaactttcaaattttacttaatttaaaattaaaaatgaaagcaaaa

SEQ ID NO: 10810 - DNA, 330 bp, Homo sapiens
ttttattctcatagtccctttaagatgtcatatttatttttttttttatatagagatgtggtctcactatgttgaccaggctggtctcaacttcctggcctcaagtgatcctcctatcttggccccccaaaatgctaggattaatagcgtgagccatcatgcccagcctaagatgtcacgcttttatcttgtgaattgttacatgttggctgtgctgtttttattggtcattcgtaagtgggtaatctaacttttcctctcaggctgacttatgaatttctatttgcctttggtgatctctgacttctagatgtatccaatctctagata

SEQ ID NO: 10811 - DNA, 3983 bp, Homo sapiens
atgaaataaactaaccactggtctagacagccggtggttatcgtgccgagggagagaggagtcggagctggacgaggacccagctgctgagccggctgaggctggtgtggggaccaccgtggcacctctgccgccagctccagcacccagcagtcagcccgtgccggctgggatgactgttcctcctcctccagctgcagccccaccactgcccagggccctggctaagcccgccgtcttcatccccgtgaaccgctccccggaaatgcaggaggaacggctgaagctcccaattctctccgaagaacaagtaatcatggaggctgtggccgagcaccccatcgtcatcgtgtgtggtgagaccggcagcgggaagaccacacaggtgcctcagtttctctatgaagcaggcttcagcagtgaagacagcatcatcggtgtcacggagccccgccgagtggccgccgtggccatgtcccagcgagtggccaaggagatgaatctgtcccagcgggtcgtctcctaccagatccggtatgaaggaaacgtgacagaggagaccagaatcaagttcatgacggatggtgtgctgcttaaagaaatccagaaggacttcctgctgctgcggtacaaggtggtgatcatcgacgaggcccacgagaggagcgtgtacacggacatcctcatcggcctcctgtcccgcattgtgactctccgggctaagaggaacctgccactcaagctgctcatcatgtcggccacgctgcgggtggaggacttcacccagaacccacggctcttcgccaagccgccgccggtcatcaaggtggaatccaggcagttcccagtgactgtgcatttcaacaagcggacaccgctggaagactacagtggcgagtgcttccggaaggtctgcaagatccaccggatgctgcccgcaggtggcatcctggtgttcctgacggggcaggctgaggtgcatgcgctgtgccgcaggctcaggaaggctttcccaccctccagagcccggccacaagaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacaggctgtattcatctgcggtttttggtgacttcgagcagtttcctcctccagaaatcacccggaggcctgttgaagacttaatccttcaaatgaaggcgctcaacgttgaaaaggtcatcaacttccccttcccgacgcccccctccgtggaagcccttcttgccgccgaggagctgttgatcgcactgggtgccctgcaaccgccccagaaagcagaaagggtgaagcaactgcaggagaaccggctgagctgccccatcactgcgctgggccggacaatggccacattccccgtggcaccccgctacgctaagatgctggcactgagccgacaacacggctgcctgccctatgccatcaccatcgtggccagcatgacggtgcgggagctgtttgaggagctggacagaccagcggccagtgacgaggagctcaccaggctgaagagcaagcgggcccgggtggcccagatgaagaggacctgggcagggcagggggcttctctgaagctcggcgacctcatggtgctgctgggcgccgtgggagcctgtgagtatgccagctgcacaccccagttttgcgaagccaacgggctgcggtacaaagccatgatggagatccggcgcctgcggggccagctgaccaccgcagtcaatgccgtgtgccccgaggctgagctcttcgtggatcccaagatgcagccgcccaccgagagccaggtgacctacctgcgacagatcgtgacggcaggcctgggggaccacttggcccgcagggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagcgtggaggtccagtggatcccggccctgctgccctcttactgccagtttgacaagcccctggaggaaccagcccctacatactgccccgagcgggggcgggtgctgtgtcaccgggccagcgtgttctatcgcgtgggctggccgctccccgccatcgaggtggattttccagaggggattgaccgctacaagcactttgcccggttcctgctggaagggcaggtcttccgcaagctggcctcataccggagctgtctgctgtccagccccggcaccatgctgaagacgtgggccaggctgcagccccgtacggagagccttctgcgagccctggttgcagagaaggctgactgccatgaagccttgctggctgcttggaagaaaaaccccaaatacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcaccca

SEQ ID NO: 10812 - DNA, 3382 bp, Homo sapiens
tagccccccttccacgagcctctgtcggtgaccgggtcctctcatggagaggcccacgagaggagcgtgtacacggacatcctcatcggcctcctgtcccgcattgtgactctccgggctaagaggaacctgccactcaagctgctcatcatgtcggccacgctgcgggtggaggacttcacccagaacccacggctcttcgccaagccgccgccggtcatcaaggtggaatccaggcagttcccagtgactgtgcatttcaacaagcggacaccgctggaagactacagtggcgagtgcttccggaaggtctgcaagatccaccggatgctgcccgcaggtggcatcctggtgttcctgacggggcaggctgaggtgcatgcgctgtgccgcaggctcaggaaggctttcccaccctccagagcccggccacaagaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacaggctgtattcatctgcggtttttggtgacttcgagcagtttcctcctccagaaatcacccggaggcctgttgaagacttaatccttcaaatgaaggcgctcaacgttgaaaaggtcatcaacttccccttcccgacgcccccctccgtggaagcccttcttgccgccgaggagctgttgatcgcactgggtgccctgcaaccgccccagaaagcagaaagggtgaagcaactgcaggagaaccggctgagctgccccatcactgcgctgggccggacaatggccacattccccgtggcaccccgctacgctaagatgctggcactgagccgacaacacggctgcctgccctatgccatcaccatcgtggccagcatgacggtgcgggagctgtttgaggagctggacagaccagcggccagtgacgaggagctcaccaggctgaagagcaagcgggcccgggtggcccagatgaagaggacctgggcagggcagggggcttctctgaagctcggcgacctcatggtgctgctgggcgccgtgggagcctgtgagtatgccagctgcacaccccagttttgcgaagccaacgggctgcggtacaaagccatgatggagatccggcgcctgcggggccagctgaccaccgcagtcaatgccgtgtgccccgaggctgagctcttcgtggatcccaagatgcagccgcccaccgagagccaggtgacctacctgcgacagatcgtgacggcaggcctgggggaccacttggcccgcagggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagcgtggaggtccagtggatcccggccctgctgccctcttactgccagtttgacaagcccctggaggaaccagcccctacatactgccccgagcgggggcgggtgctgtgtcaccgggccagcgtgttctatcgcgtgggctggccgctccccgccatcgaggtggattttccagaggggattgaccgctacaagcactttgcccggttcctgctggaagggcaggtcttccgcaagctggcctcataccggagctgtctgctgtccagccccggcaccatgctgaagacgtgggccaggctgcagccccgtacggagagccttctgcgagccctggttgcagagaaggctgactgccatgaagccttgctggctgcttggaagaaaaaccccaaatacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcaccca

SEQ ID NO: 10813 - DNA, 4445 bp, Homo sapiens
atgaaataaactaaccactggtctagacagccggtggttatcgtgccgagggagagaggagtcggagctggacgaggacccagctgctgagccggctgaggctggtgtggggaccaccgtggcacctctgccgccagctccagcacccagcagtcagcccgtgccggctgggatgactgttcctcctcctccagctgcagccccaccactgcccagggccctggctaagcccgccgtcttcatccccgtgaaccgctccccggaaatgcaggaggaacggctgaagctcccaattctctccgaagaacaagtaatcatggaggctgtggccgagcaccccatcgtcatcgtgtgtggtgagaccggcagcgggaagaccacacaggtgcctcagtttctctatgaagcaggcttcagcagtgaagacagcatcatcggtgtcacggagccccgccgagtggccgccgtggccatgtcccagcgagtggccaaggagatgaatctgtcccagcgggtcgtctcctaccagatccggtatgaaggaaacgtgacagaggagaccagaatcaagttcatgacggatggtgtgctgcttaaagaaatccagaaggacttcctgctgctgcggtacaaggtggtgatcatcgacgaggcccacgagaggagcgtgtacacggacatcctcatcggcctcctgtcccgcattgtgactctccgggctaagaggaacctgccactcaagctgctcatcatgtcggccacgctgcgggtggaggacttcacccagaacccacggctcttcgccaagccgccgccggtcatcaaggtggaatccaggcagttcccagtgactgtgcatttcaacaagcggacaccgctggaagactacagtggcgagtgcttccggaaggtctgcaagatccaccggatgctgcccgcaggtggcatcctggtgttcctgacggggcaggctgaggtgcatgcgctgtgccgcaggctcaggaaggctttcccaccctccagagcccggccacaagaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacaggctgtattcatctgcggtttttggtgacttcgagcagtttcctcctccagaaatcacccggaggcctgttgaagacttaatccttcaaatgaaggcgctcaacgttgaaaaggtcatcaacttccccttcccgacgcccccctccgtggaagcccttcttgccgccgaggagctgttgatcgcactgggtgccctgcaaccgccccagaaagcagaaagggtgaagcaactgcaggagaaccggctgagctgccccatcactgcgctgggccggacaatggccacattccccgtggcaccccgctacgctaagatgctggcactgagccgacaacacggctgcctgccctatgccatcaccatcgtggccagcatgacggtgcgggagctgtttgaggagctggacagaccagcggccagtgacgaggagctcaccaggctgaagagcaagcgggcccgggtggcccagatgaagaggacctgggcagggcagggggcttctctgaagctcggcgacctcatggtgctgctgggcgccgtgggagcctgtgagtatgccagctgcacaccccagttttgcgaagccaacgggctgcggtacaaagccatgatggagatccggcgcctgcggggccagctgaccaccgcagtcaatgccgtgtgccccgaggctgagctcttcgtggatcccaagatgcagccgcccaccgagagccaggtgacctacctgcgacagatcgtgacggcaggcctgggggaccacttggcccgcagggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagcgtggaggtccagtggatcccggccctgctgccctcttactgccagtttgacaagcccctggaggaaccagcccctacatactgccccgagcgggggcgggtgctgtgtcaccgggccagcgtgttctatcgcgtgggctggccgctccccgccatcgaggtggattttccagaggggattgaccgctacaagcactttgcccggttcctgctggaagggcaggtcttccgcaagctggcctcataccggagctgtctgctgtccagccccggcaccatgctgaagacgtgggccaggctgcagccccgtacggagagccttctgcgagccctggttgcagagaaggctgactgccatgaagccttgctggctgcttggaagaaaaaccccaaatacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcacccaaaaaaaaaaaaaaaaaaaaaaaaaaaaaaaaaagggggggggggtaaaaaaataatctcccggggggggcccaatttatgggtaccacgtttttttgaaaaggggggccccaataagggggggggaattaaaaaaaagggagggggggcgggttttaacaaacgacggtgtggagcgtgtggaaaacacccgcgccaacgctggggcacctctggtcgaagaggcaaacccttaaaccgtcggggcgcggcgggcacaactactgcggggcacaactatcccctaacaagaagaattataaacgagccaaggggacaactataaaaacactttgcgacgggcgtgctacaacgggcgttcacacacaagcgcggcaaataatatgcttggcccgcatgaagaaaattattggcctacacaggaagtacatactctcgctagcaacacttttttttcgacgac

SEQ ID NO: 10814 - DNA, 3996 bp, Homo sapiens
  misc_feature (3778)..(3778): n is a, c, g, or t
  misc_feature (3780)..(3781): n is a, c, g, or t
  misc_feature (3787)..(3787): n is a, c, g, or t
atgaaataaactaaccactggtctagacagccggtggttatcgtgccgagggagagaggagtcggagctggacgaggacccagctgctgagccggctgaggctggtgtggggaccaccgtggcacctctgccgccagctccagcacccagcagtcagcccgtgccggctgggatgactgttcctcctcctccagctgcagccccaccactgcccagggccctggctaagcccgccgtcttcatccccgtgaaccgctccccggaaatgcaggaggaacggctgaagctcccaattctctccgaagaacaagtaatcatggaggctgtggccgagcaccccatcgtcatcgtgtgtggtgagaccggcagcgggaagaccacacaggtgcctcagtttctctatgaagcaggcttcagcagtgaagacagcatcatcggtgtcacggagccccgccgagtggccgccgtggccatgtcccagcgagtggccaaggagatgaatctgtcccagcgggtcgtctcctaccagatccggtatgaaggaaacgtgacagaggagaccagaatcaagttcatgacggatggtgtgctgcttaaagaaatccagaaggacttcctgctgctgcggtacaaggtggtgatcatcgacgaggcccacgagaggagcgtgtacacggacatcctcatcggcctcctgtcccgcattgtgactctccgggctaagaggaacctgccactcaagctgctcatcatgtcggccacgctgcgggtggaggacttcacccagaacccacggctcttcgccaagccgccgccggtcatcaaggtggaatccaggcagttcccagtgactgtgcatttcaacaagcggacaccgctggaagactacagtggcgagtgcttccggaaggtctgcaagatccaccggatgctgcccgcaggtggcatcctggtgttcctgacggggcaggctgaggtgcatgcgctgtgccgcaggctcaggaaggctttcccaccctccagagcccggccacaagaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacaggctgtattcatctgcggtttttggtgacttcgagcagtttcctcctccagaaatcacccggaggcctgttgaagacttaatccttcaaatgaaggcgctcaacgttgaaaaggtcatcaacttccccttcccgacgcccccctccgtggaagcccttcttgccgccgaggagctgttgatcgcactgggtgccctgcaaccgccccagaaagcagaaagggtgaagcaactgcaggagaaccggctgagctgccccatcactgcgctgggccggacaatggccacattccccgtggcaccccgctacgctaagatgctggcactgagccgacaacacggctgcctgccctatgccatcaccatcgtggccagcatgacggtgcgggagctgtttgaggagctggacagaccagcggccagtgacgaggagctcaccaggctgaagagcaagcgggcccgggtggcccagatgaagaggacctgggcagggcagggggcttctctgaagctcggcgacctcatggtgctgctgggcgccgtgggagcctgtgagtatgccagctgcacaccccagttttgcgaagccaacgggctgcggtacaaagccatgatggagatccggcgcctgcggggccagctgaccaccgcagtcaatgccgtgtgccccgaggctgagctcttcgtggatcccaagatgcagccgcccaccgagagccaggtgacctacctgcgacagatcgtgacggcaggcctgggggaccacttggcccgcagggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagcgtggaggtccagtggatcccggccctgctgccctcttactgccagtttgacaagcccctggaggaaccagcccctacatactgccccgagcgggggcgggtgctgtgtcaccgggccagcgtgttctatcgcgtgggctggccgctccccgccatcgaggtggattttccagaggggattgaccgctacaagcactttgcccggttcctgctggaagggcaggtcttccgcaagctggcctcataccggagctgtctgctgtccagccccggcaccatgctgaagacgtgggccaggctgcagccccgtacggagagccttctgcgagccctggttgcagagaaggctgactgccatgaagccttgctggctgcttggaagaaaaaccccaaatacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggaggtcccntnngaccangggaccgctcaaacaaaaacagccaagcttttgtgccaaacagattactgatatgactgttaaagcaaaaagctctgttcctgtctcagatgatgcctatccagaaatagaaaaattctttccctttaatcctttagactttgatagctttgacctgcctgaatagcacccgattgcgcaccttcccttgagtggagtgcctctaatga

SEQ ID NO: 10815 - DNA, 2975 bp, Homo sapiens
  misc_feature (4)..(4): n is a, c, g, or t
  misc_feature (68)..(68): n is a, c, g, or t
  misc_feature (128)..(128): n is a, c, g, or t
gganttgctctgctggtccggccgctggaggcccaccctggcctagtcgccatggggaagctgcgccngcctacaacatcaaggggcgccacaggcggccccggaccctcgaaggcccccccgagccnccccccgtgcagctggaactggaggacaaggacacgttgaagggagttgatgcaagcaacgcgctcgttctaccggggaagaagaaaaagaagaccaaagcccctcccctgtcgaagaaggagaagaagcctctgaccaagaaggagaagaaagtgctgcagaaaatcttagaacagaaggagaaaaagagccagcgagcagagatgctacagaagctgagtgaagtccaggcttccgaagctgagatgagactcttttataccacttccaagctaggcactgggaaccgcatgtatcacaccaaagagaaggctgacgaggtggtagccccgggccaggagaagatcagtagcctcagcggtgcccaccggaagcgtcgccgctggccctcagctgaggaggaggaggaggaggaggaggagtcggaatcggagctggaggaggagtcggagctggacgaggacccagctgctgagccggctgaggctggtgtggggaccaccgtggcacctctgccgccagctccagcacccagcagtcagcccgtgccggctgggatgactgttcctcctcctccagctgcagccccaccactgcccagggccctggctaagcccgccgtcttcatccccgtgaaccgctccccggaaatgcaggaggaacggctgaagctcccaattctctccgaagaacaagtaatcatggaggctgtggccgagcaccccatcgtcatcgtgtgtggtgagaccggcagcgggaagaccacacaggtgcctcagtttctctatgaagcaggcttcagcagtgaagacagcatcatcggtgtcacggagccccgccgagtggccgccgtggccatgtcccagcgagtggccaaggagatgaatctgtcccagcgggtcgtctcctaccagatccggtatgaaggaaacgtgacagaggagaccagaatcaagttcatgacggatggtgtgctgcttaaagaaatccagaaggacttcctgctgctgcggtacaaggtggtgatcatcgacgaggcccacgagaggagcgtgtacacggacatcctcatcggcctcctgtcccgcattgtgactctccgggctaagaggaacctgccactcaagctgctcatcatgtcggccacgctgcgggtggaggacttcacccagaacccacggctcttcgccaagccgccgccggtcatcaaggtggaatccaggcagttcccagtgactgtgcatttcaacaagcggacaccgctggaagactacagtggcgagtgcttccggaaggtctgcaagatccaccggatgctgcccgcaggtggcatcctggtgttcctgacggggcaggctgaggtgcatgcgctgtgccgcaggctcaggaaggctttcccaccctccagagcccggccacaagaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacagttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcaccca

SEQ ID NO: 10816 - DNA, 789 bp, Homo sapiens
gcaggtagcgaggctgggtggcggaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacaggctgtattcatctgcggtttttggtgacttcgagcagtttcctcctccagaaatcacccggaggcctgttgaagacttaatccttcaaatgaaggcgctcaacgttgaaaagtcatcaattccccttcccgacgccccctcggggaagccttctggcgcgaggagtgttgacgcctggtggcctgaacggccagaagggaaggtggcctgggggacgtggtgcc

SEQ ID NO: 10817 - DNA, 4693 bp, Homo sapiens
  misc_feature (4)..(4): n is a, c, g, or t
  misc_feature (68)..(68): n is a, c, g, or t
  misc_feature (128)..(128): n is a, c, g, or t
gganttgctctgctggtccggccgctggaggcccaccctggcctagtcgccatggggaagctgcgccngcctacaacatcaaggggcgccacaggcggccccggaccctcgaaggcccccccgagccnccccccgtgcagctggaactggaggacaaggacacgttgaagggagttgatgcaagcaacgcgctcgttctaccggggaagaagaaaaagaagaccaaagcccctcccctgtcgaagaaggagaagaagcctctgaccaagaaggagaagaaagtgctgcagaaaatcttagaacagaaggagaaaaagagccagcgagcagagatgctacagaagctgagtgaagtccaggcttccgaagctgagatgagactcttttataccacttccaagctaggcactgggaaccgcatgtatcacaccaaagagaaggctgacgaggtggtagccccgggccaggagaagatcagtagcctcagcggtgcccaccggaagcgtcgccgctggccctcagctgaggaggaggaggaggaggaggaggagtcggaatcggagctggaggaggagtcggagctggacgaggacccagctgctgagccggctgaggctggtgtggggaccaccgtggcacctctgccgccagctccagcacccagcagtcagcccgtgccggctgggatgactgttcctcctcctccagctgcagccccaccactgcccagggccctggctaagcccgccgtcttcatccccgtgaaccgctccccggaaatgcaggaggaacggctgaagctcccaattctctccgaagaacaagtaatcatggaggctgtggccgagcaccccatcgtcatcgtgtgtggtgagaccggcagcgggaagaccacacaggtgcctcagtttctctatgaagcaggcttcagcagtgaagacagcatcatcggtgtcacggagccccgccgagtggccgccgtggccatgtcccagcgagtggccaaggagatgaatctgtcccagcgggtcgtctcctaccagatccggtatgaaggaaacgtgacagaggagaccagaatcaagttcatgacggatggtgtgctgcttaaagaaatccagaaggacttcctgctgctgcggtacaaggtggtgatcatcgacgaggcccacgagaggagcgtgtacacggacatcctcatcggcctcctgtcccgcattgtgactctccgggctaagaggaacctgccactcaagctgctcatcatgtcggccacgctgcgggtggaggacttcacccagaacccacggctcttcgccaagccgccgccggtcatcaaggtggaatccaggcagttcccagtgactgtgcatttcaacaagcggacaccgctggaagactacagtggcgagtgcttccggaaggtctgcaagatccaccggatgctgcccgcaggtggcatcctggtgttcctgacggggcaggctgaggtgcatgcgctgtgccgcaggctcaggaaggctttcccaccctccagagcccggccacaagaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacaggctgtattcatctgcggtttttggtgacttcgagcagtttcctcctccagaaatcacccggaggcctgttgaagacttaatccttcaaatgaaggcgctcaacgttgaaaaggtcatcaacttccccttcccgacgcccccctccgtggaagcccttcttgccgccgaggagctgttgatcgcactgggtgccctgcaaccgccccagaaagcagaaagggtgaagcaactgcaggagaaccggctgagctgccccatcactgcgctgggccggacaatggccacattccccgtggcaccccgctacgctaagatgctggcactgagccgacaacacggctgcctgccctatgccatcaccatcgtggccagcatgacggtgcgggagctgtttgaggagctggacagaccagcggccagtgacgaggagctcaccaggctgaagagcaagcgggcccgggtggcccagatgaagaggacctgggcagggcagggggcttctctgaagctcggcgacctcatggtgctgctgggcgccgtgggagcctgtgagtatgccagctgcacaccccagttttgcgaagccaacgggctgcggtacaaagccatgatggagatccggcgcctgcggggccagctgaccaccgcagtcaatgccgtgtgccccgaggctgagctcttcgtggatcccaagatgcagccgcccaccgagagccaggtgacctacctgcgacagatcgtgacggcaggcctgggggaccacttggcccgcagggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagcgtggaggtccagtggatcccggccctgctgccctcttactgccagtttgacaagcccctggaggaaccagcccctacatactgccccgagcgggggcgggtgctgtgtcaccgggccagcgtgttctatcgcgtgggctggccgctccccgccatcgaggtggattttccagaggggattgaccgctacaagcactttgcccggttcctgctggaagggcaggtcttccgcaagctggcctcataccggagctgtctgctgtccagccccggcaccatgctgaagacgtgggccaggctgcagccccgtacggagagccttctgcgagccctggttgcagagaaggctgactgccatgaagccttgctggctgcttggaagaaaaaccccaaatgtgagtttgaccagggccagggggtgggagtagacaggatggggtcactgaggcaggggctttgtgctttgtgcacggtcagccctggcttggcagaaggatctggccccacggctgctggccagctttttgccacctgaggagagtccctgggcccagggtcaccctgacactgtcctccttccctcccctgcagacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcaccca

SEQ ID NO: 10818 - DNA, 2988 bp, Homo sapiens
ttagtactataacgggcgtatgtagcgaggcctgggtggcggaaaaggacgacgatcagaaagactcggtggaggaaatgcggaagtttaagaagtcaagggccagggccaagaaggcgcgggctgaggtgctgccccagatcaacttggatcattactcggtgttaccggcaggcgaaggcgatgaggacagggaggcagaagtggatgaggaagagggggccctggactccgacctcgatctggacctgggggatggcgggcaagatggaggtgagcagccggatgcctccctcccgctccacgtgctcccgctgtactctctgctggccccagagaagcaagcacaggtctttaagcctccaccggaggggactcggttgtgtgttgtggccaccaatgtggccgagacgtcgcttaccatccctggcatcaagtacgtggtggactgtgggaaggtcaagaaacgctactacgaccgcgtcactggcgtatcctccttccgtgtcacctgggtctcccaggcatcagctgaccagcgagcgggcagagcaggacggacggagcccggccactgctacaggctgtattcatctgcggtttttggtgacttcgagcagtttcctcctccagaaatcacccggaggcctgttgaagacttaatccttcaaatgaaggcgctcaacgttgaaaaggtcatcaacttccccttcccgacgcccccctccgtggaagcccttcttgccgccgaggagctgttgatcgcactgggtgccctgcaaccgccccagaaagcagaaagggtgaagcaactgcaggagaaccggctgagctgccccatcactgcgctgggccggacaatggccacattccccgtggcaccccgctacgctaagatgctggcactgagccgacaacacggctgcctgccctatgccatcaccatcgtggccagcatgacggtgcgggagctgtttgaggagctggacagaccagcggccagtgacgaggagctcaccaggctgaagagcaagcgggcccgggtggcccagatgaagaggacctgggcagggcagggggcttctctgaagctcggcgacctcatggtgctgctgggcgccgtgggagcctgtgagtatgccagctgcacaccccagttttgcgaagccaacgggctgcggtacaaagccatgatggagatccggcgcctgcggggccagctgaccaccgcagtcaatgccgtgtgccccgaggctgagctcttcgtggatcccaagatgcagccgcccaccgagagccaggtgacctacctgcgacagatcgtgacggcaggcctgggggaccacttggcccgcagggtccagagcgaggagatgctggaggacaagtggaggaacgcctacaagacccctctcctcgacgaccctgtcttcatccaccccagctccgtccttttcaaagagctccccgagtttgtggtctaccaggaaatcgtggagaccactaagatgtacatgaaaggcgtctctagcgtggaggtccagtggatcccggccctgctgccctcttactgccagtttgacaagcccctggaggaaccagcccctacatactgccccgagcgggggcgggtgctgtgtcaccgggccagcgtgttctatcgcgtgggctggccgctccccgccatcgaggtggattttccagaggggattgaccgctacaagcactttgcccggttcctgctggaagggcaggtcttccgcaagctggcctcataccggagctgtctgctgtccagccccggcaccatgctgaagacgtgggccaggctgcagccccgtacggagagccttctgcgagccctggttgcagagaaggctgactgccatgaagccttgctggctgcttggaagaaaaaccccaaatacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcaccca

SEQ ID NO: 10819 - DNA, 1593 bp, Homo sapiens
accatgcccggcaaatatttttggatttttagtagagctagggtttcaccatgttagccaggctggtctcgaactcctggcctcaggtgatccacctgcctcagcttcccaaagtgctgggattacaggcgtgagccaccacgctcagccagtttgtttgtttttgagacaagttcttgccctgttgcccaggctggagtgcagtggtgcagtcatggttcactgcagcctccaactcccaggctcaagggatcctcctacttcagccccctgagtaactggggctacaggtgcatgtcaccatgcccagccagctcttcaccctcctgggtggggctggtggggtggtgatgcctgccctgctttcgggcccccagcagcagccggtctgtgccctggctgcctgccaccaacgtgcattcctgccccacaggctgcagccccgtacggagagccttctgcgagccctggttgcagagaaggctgactgccatgaagccttgctggctgcttggaagaaaaaccccaaatacctgctggctgagtactgtgagtggcttccacaggccatgcaccccgatatcgagaaagcctggccccccaccactgtccactgaccagaaacctggctgcagggccgaggactggtttggggactggagggctggcagcagcctgtcaccgtgcgaccgtgaccacctggcatgggcttcgtggcctgctctcaggaagtgggtcaagccctgggaaccctcatccatgagagctcgatcccgtatgaagggtgctgccgcccgtgccatctggcccgggggtgactttttgaactgtttattatatggtggatgatgatttcatctcacgtgctggacgctgttctgttcagtgtgctctttggactacattagtcccctgtggagcagcagggctggagatctctgcagtcccttccccgcccgccctgccagaaggccgaggaggcacgtggagggcctccttcctgcaattcttccctctccagagtcagggagggctgcccagccctggcctcacagccgtcccagatgttaggtgagccactgagctctgtgttgaccttgaggggcctggctgggggcccccaggctccatgccttcttgggagggtggccgccaacgcctttcctgtgttatggcaacagggagtgggcatctcatctgcctgtggtcagctctcagacggcagggagcggagctgacgttggctgtgcttggtcaccgctgccatgccgcagaggatgcgcctagctgggctggggccacacgactattatgttggccttgaacggggactgcagagccctcagtttgtctcccttgttcctctgtggctgaggtgggagggggagggtggggtaggtcccccagcaagaaagagggacaggagcaccccaggcaggaccaaggagtcgggaggcccctgccttctgtcctccatggtgagggcacagatgtctccccagagcccagcgctggcagaatggattctgctcctggctttgcttctgcggcttcggtggagacagttatggaataaaatgttccttgcaccca

SEQ ID NO: 10820 - DNA, 804 bp, Homo sapiens
gggctgcaggaattcggcacgaggaaagaaagaattcacctaaaagattccatttccagttttataatgtatttcaggttctgaataacaatatttttccaaattgaaagtaaatattcaagaagttgatagcctggttaaaagttagatcctctattaccattctaagcacattcacttctatattgaagttttggtaaaaattcttttttcttttttaataaaaaattaggttattactttttttataaccagatttttaaagcactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccattatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgtattttatatgatctacaacatataaaattgtgtatttttctttggttgtccctattaacaaaaaagtattttaataaaaaataaaattgaaatgagtgagtc

SEQ ID NO: 10821 - DNA, 2154 bp, Homo sapiens
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacatgaagtctgatgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaaagcgtttctgtgacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattataatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagt

SEQ ID NO: 10822 - DNA, 342 bp, Homo sapiens
aattcaagcttctaacgatgtacggggacatgtgatttctaaaattccagaaagcaaaattgataagatgttagaaatttggaccattatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgtattttatatgatctacaacatataaaattgtgtatttttctttggttgtccctattaacaaaaaagtattttaataaaaaataaaattgaaatgagtgagtc

SEQ ID NO: 10823 - DNA, 3768 bp, Homo sapiens
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacatgaagtctgatgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaaagcgtttctgtgacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattataatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagtaataaaatctcaatcttaaagcatgaatctaaaacataaatatttatattacagactcaattttacaaaattactaattgctctagtgcatatttgaactacaagcaactttttaggaatacctctttatacgtctacatattttagtatataaaaatagataatgctcttggacacattttgtattattcatgatctgaatagtagttagttaaaagatcatttgtaatattatgatcaactgttataaattaaggtcttaataccttttctgctctttcaaataactctaatgaatattcaagatattttagccttttaaaaagttgagatttagctcatggatatattttttggtagggaaacattagggtctccttttcttccttttacctagaatgcctcatttaaaagtgccttgaaaacatttagctccccttcttcatgagcatctgtagagctgaaagtattctggaactttagacagaaagctgaaaggaatctgcagtctcctgctgcagttcaactctgctgtttttcagtcatttcctactgtgagtggagtgatgttgtgtgtgtgttggcaacatgcctaatgttttcttaatgatgacaacaaatattttaaaactgcatttatcattttttaggtcttcattaaattttaaaatgtaatatctgtttcccaccccctacattaggaggataatttcttaaaccacattgttttaattgatttttcttatcttgatttctttcattagaaactatccctaaatgtaaagatcttttgccttcaaatttggcttattttttctgatttatgagggtttgaaagaaagaattcacctaaaagattccatttccagttttataatgtatttcaggttctgaataacaatatttttccaaattgaaagtaaatattcaagaagttgatagcctggttaaaagttagatcctctattaccattctaagcacattcacttctatattgaagttttggtaaaaattcttttttcttttttaataaaaaattaggttattactttttttataaccagatttttaaagcactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccattatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgtattttatatgatctacaacatataaaattgtgtatttttctttggttgtccctattaacaaaaaagtattttaataaaaaataaaattgaaatgagtgagtc

SEQ ID NO: 10824 - DNA, 3704 bp, Homo sapiens
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacatgaagtctgatgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattataatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagtaataaaatctcaatcttaaagcatgaatctaaaacataaatatttatattacagactcaattttacaaaattactaattgctctagtgcatatttgaactacaagcaactttttaggaatacctctttatacgtctacatattttagtatataaaaatagataatgctcttggacacattttgtattattcatgatctgaatagtagttagttaaaagatcatttgtaatattatgatcaactgttataaattaaggtcttaataccttttctgctctttcaaataactctaatgaatattcaagatattttagccttttaaaaagttgagatttagctcatggatatattttttggtagggaaacattagggtctccttttcttccttttacctagaatgcctcatttaaaagtgccttgaaaacatttagctccccttcttcatgagcatctgtagagctgaaagtattctggaactttagacagaaagctgaaaggaatctgcagtctcctgctgcagttcaactctgctgtttttcagtcatttcctactgtgagtggagtgatgttgtgtgtgtgttggcaacatgcctaatgttttcttaatgatgacaacaaatattttaaaactgcatttatcattttttaggtcttcattaaattttaaaatgtaatatctgtttcccaccccctacattaggaggataatttcttaaaccacattgttttaattgatttttcttatcttgatttctttcattagaaactatccctaaatgtaaagatcttttgccttcaaatttggcttattttttctgatttatgagggtttgaaagaaagaattcacctaaaagattccatttccagttttataatgtatttcaggttctgaataacaatatttttccaaattgaaagtaaatattcaagaagttgatagcctggttaaaagttagatcctctattaccattctaagcacattcacttctatattgaagttttggtaaaaattcttttttcttttttaataaaaaattaggttattactttttttataaccagatttttaaagcactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccattatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgtattttatatgatctacaacatataaaattgtgtatttttctttggttgtccctattaacaaaaaagtattttaataaaaaataaaattgaaatgagtgagtc

SEQ ID NO: 10825 - DNA, 1222 bp, Homo sapiens
cgccattctcctgcctcagcctcccaagtagctgggactacaggcgcccgcacgtacgcccggctaatttttttgtatttttagtagagacggggtttcaccgttttagccgggatgcctcgatctcctgacctcgtgatccgcccgcctcggcctcccaaagtgctgggattacaggcgtgacaccgcgcccggcatgcctaatgttttcttaatgatgacaacaaatattttaaaactgcatttatcattttttaggtcttcattaaattttaaaatgtaatatctgtttcccaccccctacattaggaggataatttcttaaaccacattgttttaattgatttttcttatcttgatttctttcattagaaactatccctaaatgtaaagatcttttgccttcaaatttggcttattttttctgatttatgagggtttgaaagaaagaattcacctaaaagattccatttccagttttataatgtatttcaggttctgaataacaatatttttccaaattgaaagtaaatattcaagaagttgatagcctggttaaaagttagatcctctattaccattctaagcacattcacttctatattgaagttttggtaaaaattcttttttcttttttaataaaaaattaggttattactttttttataaccagatttttaaagcactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccattatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgtattttatatgatctacaacatataaaattgtgtatttttctttggttgtccctattaacaaaaaagtattttaataaaaaataaaattgaaatgagtgagtc

SEQ ID NO: 10826 - DNA, 1897 bp, Homo sapiens
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacatgaagtctgatgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaaagcgtttctgtgacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaaggcctccagcaccagacatctaccccccctcctaataactgttactaaactatctaggccaactctcatcaacatactcaag

SEQ ID NO: 10827 - DNA, 824 bp, Homo sapiens
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggttcatccatgttgtaaatcagggtccccaacccctgagccatggaccagtagcagtccgccgcctcttaggaaccgggccacatagaaggaggtgaacaccaggcaagcgagcgtcaccgcctgagctccgtctcctgtcaggtcagcggcagtattggattcttacaggagctcgaaccctattgtgaactgcacatacgaggggtctcagttgcatgctccttatgagaatctaatgcctgatgatctgaggtggaacagtttcatcccaaaaccagtcctggtgccaaaaaggctgggggctactgataggatttccttctttttttaaggctgaatagtattccattgtatataaagtggaattgtattttatattgtataaatataccacattgtacatatcca

SEQ ID NO: 10828 - DNA, 2081 bp, Homo sapiens
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaaggtaactgccaacagttgactttttccattccgccccctcatgtggtctgtccatgtaatctataaaacctatataagaccatcttttggagcagccttttggttttgaatttgtatcatctcacataaattctagactcaataaccctgatcccatcatatctagaggcacatgccagaaggataagagaaaaaaaaatatctccaatccttgagtagataaaaaggcatgtcggctgggcgtggtggctcatgcctgtaatcccagcactttgggaggccgaggcaggtggatcacgaggtcaagagttcgagaccagcctgaccaacatggtgaaaccccatctctactaagaatacaaaaattagccgggtgtggtggcgggcgcctgtagtccagctacgagggaggctgaggcaggagaattgcttgaacctgagagtcggaggttgctgtgaaccgagatcacaccactgcactccagcctgggtggcagagcaagactccgtctcaccaaaaaaaaaaaagataaagaggcatgtcagcatattgtcagaattcctccatactcctggcagcagaggctgtactgtattggaaaatagataattgttcctaattctggtatttatttgtgctaggctttattctgttcataagatagcaacaatgctgcttctctaataaaatattgctcattgtcaggtgacattcagagtatcccatgaagtcagatttttataatagcacccgtaccaaaatgatgccaaagtcattagctaaatttctttataagcaagttggtattccagacatctcatttccaggcataaactaaccccagccagttctctgcaaatgggtgctgttggtcagaaaaggaattaagtgagaaaataacttatacaaattacagaagcatatttaagagcatttattagtgaagataggtcatatcataattttggaatgtaaagagcatgtgacttttataaaatctttgatattttttgacaaaaggcaccatataattttactgtggaagcataaagcacttatgaaaattgcaattatttcttaaaacatgaggtgaattatgtataaatagtataatttgtactcttacttgactattagttgtgccctccattacattcctacctatataaaacagtgcgggctgggtgcggtggctcacgcctgtaatcccagcactttgagaggctgaggcgggcacatcacctgaggtcgggagtttgagaccagcctgaccaacatgagagacctcgtctctactagaaatacaaaattagctgggcgtggtagcacatgcctgtaatcccagctacttgggaggctgaagcaggagaactgcttgagcctgggaggtggaggttgcg

SEQ ID NO: 10829 - DNA, 2312 bp, Homo sapiens
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttgattgaccctcctttcatttctgtcatgccacttgacaatgaaggaactgtatcagttgacctatagaatagcccacattccggatttgactgcttcctgtggaagtcctaccatactgactgttctgtcataaacaattttcataggattatgttaaggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacatgaagtctgatgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaaagcgtttctgtgacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattataatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagt

SEQ ID NO: 10830 - DNA, 3748 bp, Homo sapiens
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacatgaagtctgatgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaaagcgtttctgtgacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattataatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagtaataaaatctcaatcttaaagcatgaatctaaaacataaatatttatattacagactcaattttacaaaattactaattgctctagtgcatatttgaactacaagcaactttttaggaatacctctttatacgtctacatattttagtatataaaaatagataatgctcttggacacattttgtattattcatgatctgaatagtagttagttaaaagatcatttgtaatattatgatcaactgttataaattaaggtcttaataccttttctgctctttcaaataactctaatgaatattcaagatattttagccttttaaaaagttattttttggtagggaaacattagggtctccttttcttccttttacctagaatgcctcatttaaaagtgccttgaaaacatttagctccccttcttcatgagcatctgtagagctgaaagtattctggaactttagacagaaagctgaaaggaatctgcagtctcctgctgcagttcaactctgctgtttttcagtcatttcctactgtgagtggagtgatgttgtgtgtgtgttggcaacatgcctaatgttttcttaatgatgacaacaaatattttaaaactgcatttatcattttttaggtcttcattaaattttaaaatgtaatatctgtttcccaccccctacattaggaggataatttcttaaaccacattgttttaattgatttttcttatcttgatttctttcattagaaactatccctaaatgtaaagatcttttgccttcaaatttggcttattttttctgatttatgagggtttgaaagaaagaattcacctaaaagattccatttccagttttataatgtatttcaggttctgaataacaatatttttccaaattgaaagtaaatattcaagaagttgatagcctggttaaaagttagatcctctattaccattctaagcacattcacttctatattgaagttttggtaaaaattcttttttcttttttaataaaaaattaggttattactttttttataaccagatttttaaagcactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccattatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgtattttatatgatctacaacatataaaattgtgtatttttctttggttgtccctattaacaaaaaagtattttaataaaaaataaaattgaaatgagtgagtc

SEQ ID NO: 10831 - DNA, 1207 bp, Homo sapiens
ctctttaaggtgcccgaggctcgcgggcgctgcgctgaggggacggcgggaggcgcggcctggcctcgcactcaaagccgccgcagcgcgccccgggctcggccgacccggcggggatctaggggtgggcgacttcgcgggaccgtggcgcatgtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggagctctgccagtgccggccgggagaaggcaattgctcctgctgtaaggagtgcatgctgtgtcttggggccctttgggacgagtgctgtgactgtgttggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaaggtaactgccaacagttgactttttccattccgccccctcatgtggtctgtccatgtaatctataaaacctatataagaccatcttttggagcagccttttggttttgaatttgtatcatctcacataaattctagactcaataaccctgatcccatcatatctagaggcacatgccagaaggataagagaaaaaaaaatatctccaatccttgagtagataaaaaggcatgtcggctgggcgtggtggctcatgcctgtaatcccagcactttgggaggccgaggcaggtggatcacgaggtcaagagttcgagaccagcctgaccaacatggtgaaaccccatctctactaagaatacaaaaattagccgggtgtggtggcgggcgcctgtagtccagctacgagggaggctgaggcaggagaattgcttgaacctgagagtcggaggttgctgtgaaccgagatcacaccacttaaacggcgctggtgcaagcatcagcaccaggggaccgcgggcgggcgggg

SEQ ID NO: 10832 - DNA, 2430 bp, Homo sapiens
agctgtcccaggtggcccagctcagcaatggcaatgggggtccccagagtcattctgctctgcctctttggggctgcgctctgcctgacagggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacccggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcccgcccttgtgccccacaacctggccaacagtactggaagaaactggacacagtcaccagcatcccaggggagggcaaaacagccatgtcgtgccctgatgaagagcaattctgatcacagctgttactcactgagcaccagccaggcaccaggcaccccataaccacggcttcctgtgctcttcctccagagcctgtcgcagctctaggagggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtgtaaatgggctacttgtcataagccctaagtcacaggtcaacaaactgagaggcaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcgcattctaggtagaggagacagcctggacaaaggtctgagggaggaaggaacacaaggagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctgctattgtctgaatgtttgtgtctccccaaaattcatcttttgaaacctaattaccaaagtgatattactgggaggtggggcctttgggaggtggtgagatcatgagggtggagcccccatgaataggattagtgcccttataaaagaggccctggagagctgccttgccccttccaccacatgagaacacagccagcaggtgcctataagcaagaaagtgggttctcaccagccatcgaatctgctggtgcattgattgcagacttcccagactccagagctatgagacataaatttctgttgtgtataagccat

SEQ ID NO: 10833 - DNA, 2408 bp, Homo sapiens
ggaaggagacatcgaagcagggcgaggcgcagagggcgttgcggactcatgccccagtcggcagtgcggggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacccggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcccgcccttgtgccccacaacctggccaacagtactggaagaaactggacacagtcaccagcatcccaggggagggcaaaacagccatgtcgtgccctgatgaagagcaattctgatcacagctgttactcactgagcaccagccaggcaccaggcaccccataaccacggcttcctgtgctcttcctccagagcctgtcgcagctctaggagggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtgtaaatgggctacttgtcataagccctaagtcacaggtcaacaaactgagaggcaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcgcattctaggtagaggagacagcctggacaaaggtctgagggaggaaggaacacaaggagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctgctattgtctgaatgtttgtgtctccccaaaattcatcttttgaaacctaattaccaaagtgatattactgggaggtggggcctttgggaggtggtgagatcatgagggtggagcccccatgaataggattagtgcccttataaaagaggccctggagagctgccttgccccttccaccacatgagaacacagccagcaggtgcctataagcaagaaagtgggttctcaccagccatcgaatctgctggtgcattgattgcagacttcccagactccagagctatgagacataaatttctgttgtgtataagccat

SEQ ID NO: 10834 - DNA, 2448 bp, Homo sapiens
agctgtcccaggtggcccagctcagcaatggcaatgggggtccccagagtcattctgctctgcctctttggggctgcgctctgcctgacagggtcccaagccctgcagtgctacagctttgagcacacctactttggcccctttgacctcagggccatgaagctgcccagcatctcctgtcctcatgagtgctttgaggctatcctgtctctggacaccgggtatcgcgcgccggtgaccctggtgcggaagggctgctggaccgggcctcctgcgggccagacgcaatcgaacccggacgcgctgccgccagactactcggtggtgcgcggctgcacaactgacaaatgcaacgcccacctcatgactcatgacgccctccccaacctgagccaagcacccgacccgccgacgctcagcggcgccgagtgctacgcctgtatcggggtccaccaggatgactgcgctatcggcaggtcccgacgagtccagtgtcaccaggaccagaccgcctgcttccagggcaatggcagaatgacagttggcaatttctcagtccctgtgtacatcagaacctgccaccggccctcctgcaccaccgagggcaccaccagcccctggacagccatcgacctccagggctcctgctgtgaggggtacctctgcaacaggaaatccatgacccagcccttcaccagtgcttcagccaccacccctccccgagcactacaggtcctggccctgctcctcccagtcctcctgctggtggggctctcagcatagaccgcccctccaggatgctggggacagggctcacacacctcattcttgctgcttcagcccctatcacatagctcactggaaaatgatgttaaagtaagaattgcactcctgtccctctggccttccatctctcccgcccttgtgccccacaacctggccaacagtactggaagaaactggacacagtcaccagcatcccaggggagggcaaaacagccatgtcgtgccctgatgaagagcaattctgatcacagctgttactcactgagcaccagccaggcaccaggcaccccataaccacggcttcctgtgctcttcctccagagcctgtcgcagctctaggagggagctatacaatgatgtctttattagtgtcatcatgagaagcccaataagcagtatgccctaacagttagtaggccaggctctggagctaagctgcatgggttcaaatcccagctccaccattcagcctgcagagaccatgagcgagttacttaagccaggctctggagctaagctgcatgggttcaaatcccagctccagcattcagcctacagagaccatgggtgagttacttaagccaggctctggagctaagctgcatgggttcaaatcccagctccaccattcagcctgcagagactgtgggtgagttacttgagctctctgtgccaatattttctcacctataaggtggaggtgaaaataaactctataacatgacaagaactacttcacagtagttgcagtgaggattcaacgagatgaacatttagtacttgggacacagcagtggcccagtgtaaatgggctacttgtcataagccctaagtcacaggtcaacaaactgagaggcaaaagcacttggttgagcttgtgtatctagtgagtatggattcagggaccagattcccagccccacgaactgctaagcaaccccacctcctaaacacatgagtgccgattaacttcacagaaaaacacacaaggcaaagttcagcgaggtgaaattctccaagctataaagatcagggaagacttcctggaggaattcacccttgagcaaaatcctaaaggatcaatagtagctggcaaaaagaagcaggaggaagcgcattctaggtagaggagacagcctggacaaaggtctgagggaggaaggaacacaaggagtgcaggacctttcatgagtgcaggacactttcataactgcatgaacttcatagagatgggatcctttagcatgttctctgtgcacatgcttgaccatgttctttcacatgctttttgccacttgatctttccagcaactcagtgagagaagcaaaaaagtaagttgcatcctgctattgtctgaatgtttgtgtctccccaaaattcatcttttgaaacctaattaccaaagtgatattactgggaggtggggcctttgggaggtggtgagatcatgagggtggagcccccatgaataggattagtgcccttataaaagaggccctggagagctgccttgccccttccaccacatgagaacacagccagcaggtgcctataagcaagaaagtgggttctcaccagccatcgaatctgctggtgcattgattgcagacttcccagactccagagctatgagacataaatttctgttgtgtataagccat

SEQ ID NO: 10835 - DNA, 694 bp, Homo sapiens
aaagcgagtgccgggagagtgtgctatttagtgagctcagtccagcctcggtcttgagcattgactgtgggtcctctgctgttggggttctcgacttgcccaccagctgccttatctcaggttgagaaaggtagtgggaaccccattttgcaaatggggaaactcttggtgacttgaagtcacctggttaaaatggcacacaactttgaagctgcctgccattttaaccaagtgtgccagacataagtttctggagtgtgtatctcgtctatgtgacactccagtaccaggttcttcccacctcagggatcagtttatggaaacacctcagaattgagaccagggcttctcaatctgtgatttggggctggataaatattagttgtgaggggcgtgttgtgcattgtaggttggttagcagcgttctcggcctctacaccctctcagttgtgaaaaccaaaaatgtgtattgagatcagccctggttgagaatcaccaagctagacctctttgggttttgttgggcaatttaacggaactctggctatgccttttttgaggcagttgtagctagcttggttcattgaagctaggtttgaaatcattcataactaagttatgatgttaggaattcgacagtccatgcattgtttcatctgaaaaacaactactctaccttgcacgacaacacata

SEQ ID NO: 10836 - DNA, 191 bp, Homo sapiens
ataaagtttaacatgttaaccataaccattttctttcaacttcagacaggtaaatgagaccaagttgtgctgcatcatctttcttgcataaaccatacctataataatgtgcaattatttaaagcagaactcttgcaaagcaatgtaggtacagaattttgctgaagtttttgaaataaacttttttcaat

SEQ ID NO: 10837 - DNA, 556 bp, Homo sapiens
cctcaagtgatccgcctgctgcagcctcccaaagtgctgggattacagatgtgagccaccatgcccagcccttaagaccttctttgaatactcctttgtatttatcttgtggccttaattttgcttttggttaaggaaattagtgaatggggtttagcttcattcttcatttagaggaaaactgtaggtaatttattctgaaagtgtggtcagacggaatctaagagaacctgtttcccttggcgacgaaaaataatcagttgaatgtctgaataacaggaatccttttctgctccctatgggaaaaaagaaaccttgagttaatattttatgtaatcagtgcaatgtgctactaggtaatgagtgggaagtagatggagaatataggaaataatgcttggtctctgttctttagaagattacaaccacaggctgggcgcggtggctcacgcctataatcccaacactttgggaggctgaggcggatggaacacgaggtcaggagttcaagaccagcctggccaagatggtgaaaccccatctctactaaaaaaaa

SEQ ID NO: 10838 - DNA, 329 bp, Homo sapiens
tttttttttttgagacagggtctcactatgttgcccaagttggtctcaaactcctggcttcaagaaatcctcccaccttggcctcccaaagtgctggaattacaggtgtgaaccaccatgcctggccccagatgtcttaatttgttctgcaatctggaacccaactttcaacttcttatggaatatcatcacttggatgttccctgggtacatcaaaatccacatttacaaaattctgagcatatcatttttcttatcctccaatcaacttttttttttttttttttgagatggagtcttgctctgtcccccaggctggagtgcagtgg

SEQ ID NO: 10839 - DNA, 630 bp, Homo sapiens
ctgttcccccgcccactgcatgtatgatatagaacgagcaccattctagatgtattagagggaagtcagttcattatatatagcatatgtcttacagaaatcagggttagagagactagataatgcagaactataaaatatatggcaaagataaaatttcactgtttgctgagaagggtgtcttcctcctttcctccctttctctctccttcttttaatagcacaagcacaattgactatcatatgggataaaatgaatttgaatccttaggttactccatgtatgaaattcccccaaaattcaaggcttaggtgtaaaaatgaaaacaaaagtcttaaaagaaaatctgggctactatatataaaaaatgtatggattggcaggagcttcttaagcaaatctagagacccagaaatttaaatttttttttaaaaagacattatatcaaatgtagagtcttttgtccagtaaaaaaaaaaaaaaaaaaaaaaacccttaagtacataataacgtaatatcaatattcaaaatagacttggaagaaaatacctgaaatatatgcaacaaatatttgtcaataatagacaaagtactcttttaaacaagaaaaaaattgaaatgacaatagg

SEQ ID NO: 10840 - DNA, 466 bp, Homo sapiens
gctcgaccttgtgagaaatactcagaggtgtggaggggcaggccccttcaaagtgatctgcccgcctgagcctcccaaagtgctgggattacaggcgtgagtcaccgcgcccagccactatttggttttaatgtaaatttttaaagtactttagatctcacactcaatcagtatcctaaaaatgacatgcagctgcttgtgtgagtatatgtctggctgtaactaaaaggaaaaaaactccctaaagcaaatggttacaatgagtaattaactctatatgacaacctaaatatattttagacaaagccattaatctcttttggagaataattaattccaataatgctagaaaagatcttggaattgaggctcaggcaggtgacgtgacttgtcccaagtcatacagttaattaatactacacttggtctactgtgccattctcctgccacccccaaactcaaccac

SEQ ID NO: 10841 - DNA, 612 bp, Homo sapiens
  misc_feature (9)..(9): n is a, c, g, or t
tgggcgggnccacggcggaatggcagcaagccagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgaccaagtagatgctggttgcctacagacattgtacagtatag

SEQ ID NO: 10842 - DNA, 896 bp, Homo sapiens
  misc_feature (9)..(9): n is a, c, g, or t
tgggcgggnccacggcggaatggcagcaagccagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaatctagaagcttcactttcaaaattctcttacatagatatggacaaggaactggagttcaaaaatgatctgggtctcactctgttgtccaggttggagtacagtggtgcaaacatggctcactgaagcttcaacctcctgggctcaagtgatcctcctacctcagcctcccaagtagctgggaccacagattgatgacaaggagtttgatattcctcaagttgatactcctccaacactggaaagcatactaaatgagactgatgatgaagatgagtcttttattcttgaggatcctacattgttaaacattgatactattgattctcactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgtaagtattttgttcttttccctcaactttgtaacctgcaatggcataatgaagtaggaatgagcatagaacaaaatacagcacttctcttggcccgaggcttaagaaaaatagaatctggctttcatggtttttgtgtgatgatttttgacttatgagacatggctacacgtcttgacagaaattagtgcagccatgaaaataaagtt

SEQ ID NO: 10843 - DNA, 516 bp, Homo sapiens
cagagactaacaggggacaacaagttgcccaggggactggcaatgtagacatctctgaaaaggtcaacttgacacaggctctgacagtcgacccacagctctgtcttctttgataaaaatcagataaacttaagactgctaattgatctgcagcctgtttaaatgttggccatgcatatcttcattgcatatgattaacacagaaagcaaatgaattgggtaagaaatgccagagtccagtgacagcagcttaaaaattggaaaaggacactagtggcctaaaaggctaggaaggatgttccccttatccatttccacttggcacatatccccaagtactaattatgaatgagactggaaaaataattgcacacactctgtacaaaatcacatgatacggacaacttttcttgcttgttgttatttccaaatagcaggagataaaccatatctgtagtgcaagcatgaggttagttttgataaaccagcaattattttacacggaaagaagagaaa

SEQ ID NO: 10844 - DNA, 273 bp, Homo sapiens
accattccaaaagatagagaaagaggtaatgctccctaagtcattctgtgaaaccagtatcgccctaattcgcaaaccaggaaaggacataagaaaaaagaaaactacagaccaatttccctgatgaatatagatgcaaaaatccttaacaaaatactagataaccaaatccaacagcccatcagaaagattatgcatcatgaacaagtgggtttcatcccagggatgcagggatggtttaacatatgcaagtcaataaatatggtacatcac

SEQ ID NO: 10845 - DNA, 555 bp, Homo sapiens
ctactgaccaaagtaagggtttgtattttttatttttatctccaggactgtccgctagtaatgtagttgctccaatgacaggcactacctaaaatgataaccacatggcagaacacctcattcaggatggccaagtcatgaacgtacgggttttgtggctgaatttttctcacttattagatatatataacgttctttcttatatatgttgaaagagtaccctgttatcttgacaagatctctataaagcaagaagttagaagagagaggggaggctgggcacagtggctcacacctgtaatcccagcactttgggaggccgaggtgggtggatgacttgaggtcagaagttcgagaccagcctggccaacatggtgaaaccccatgtctactaaaattacaaaaagtaaccagatgtggtagctcacatctgtaatgccagctactcaggaagctgaggcaccagaatcacttgaactcaggaggcggagattacagtgagctgagatcgtgccactgcatgccagcctaagcaacagagtgaaactccatctt

SEQ ID NO: 10846 - DNA, 301 bp, Homo sapiens
agtgcctgtgtttgcaaacactgggcgacactggcctttcaatgtgtgggactgctgatggaggcagaggtgagacagcaaagtcacctggtccacccccttcctcaagatgatctcagcacagcctgcagtgactgcctcggatgggaatgacagccaaatgctgtagagggcgtatttcagggagtggatatggtggtaaaggtatgctaaaaactcacattgtggacggagggaaacgaggcttggggtctatattgcagtggtctccaaacattttttattgtgtatctctctttcc

SEQ ID NO: 10847 - DNA, 459 bp, Homo sapiens
gcgagatacccaaggctcagagagctaaagtgacttttgcaaggttacaaagacaattagtggctgagcttgccttgaaacccaggtgccctacctcctgccttaaggtttttctagtctctttgcactgcctccctgccatgccacaccccactgcctagtgctacatcacaaagacctgtgaaaagtgaaacccagagcgttctcaagaaatggaggcacaaatgcacagttattgtttttcttgcaactgtgtacgtggggggcattaacattcacccaggagctgctgaaatccgctcaaccagaacaaggctggtgaggagagaactgaccaaatttgtttacagggggctaatctggctctgtctctcactccacacagcctgggagaaagtctaattacagcctgacagcccagagtgtctcatgggaagacgaatcttgaataaaagtatg

SEQ ID NO: 10848 - DNA, 424 bp, Homo sapiens
ttttttttttgagatggagttttgctcttattgcccaggctggagtgcaatgacacgatctcaactgactgcaacctctgcctcctgggttcaagcaattctcctgcctcagcctcccggatagctgggattacaggcatgcaccaccatgcccggctagttttgttttgttagtagagatggggtttctccatgttggtcaggctggtctcaaactcccgaccccaggagatccacccgtctcagcctctcaaagtactgggattacaggcgtgagccaccactcccggcctacaagcaattttagaatatttttatcacctcaaaaagaaatcccatagtcacttagcttccaatactcccatcctcttcattccaaggcaatcactaatcaatctactttctacctctagagatttgtctg

SEQ ID NO: 10849 - DNA, 270 bp, Homo sapiens
agtagaagaaaagaaataataaaataataaataaaataaaaatcagagcagaaataaataaatcaaactgaaatgaaggaaagaatacagtcatcaaaatgaaaacttggtgttttgaaaagacaaataaaattgaccaacttttagccagactaaaaaaaaaaaagagaagacccaaataaaatcagagatgaaaaggtagacattacagccaataccactgaaattcaaaggatcattaagtgactactgtgagcaactaactatatg

SEQ ID NO: 10850 - DNA, 413 bp, Homo sapiens
aagcacctttttttccattctcccatcaatggaggcagtttcatgtcctcagttgtaagagctgtcccaagctagcacctgggcttcatgtaacctcctcactcggcctccatctaatccctgaacccctcccccagccctgtatgccgcttttcagggcacaccctttctttctccttaggatctgagctctagaccttacactccagctaaagtcagaaaaatagttcccaaatgccattattctcattttttgtaaattttgtagcattttattccttcacacagacttccctaatatgtatcaaaagcccagtgatgatttttcttctcaatgctaaacatcctgacatgtaaaatattaataattacagcaataatttcagtttggactaaacatattgttttctaga

SEQ ID NO: 10851 - DNA, 399 bp, Homo sapiens
gggcagcagcaatgaggccttctggaggggtctgcacacacccctctggatctgtcctggtgatgtcctgctgggctgaacccctcccaccacctgctatcattccattcaccccctgaatgtcctgggcaaaacgtgtcaggccacagggaggaactttctgctggtggttccctaaagatcctctgatgtaggaagccactgcctgcaagtttaaagtcccagttttcagataagtatgagtttatacttgtttatatattttttccttagagtctctggttggctttctttttttcctccaatgggcaagaacttggacttttttttttctcttttctttccccaaaccctttgatgaaagcttcaggagcattcaactaatagattggctggtaa

SEQ ID NO: 10852 - DNA, 1240 bp, Homo sapiens
caccgtgcccggccccaggttttattttttaaaggtttgctttttccacaaaatttgaatctttcaggctaggaatttggatttggatttcagaagggttttgggtgcctgagggagctatcagggttttgttggtaatttacatctgtgtaaaaagtgaaataacgttgtcgtatttactaatgaggatgtgtttctgacattccacagtattcctcagtgagcagttctgtgaggcatttccatcttatctctgtaatgagaacacctacatttttgtggagacattggttgtcatatcttatgtacccatgagtcaaagaactgtgtatgcccttgcccttcgttgactgcaaaccctaaggcaagaaggcctgtttggaccactccctgccaactttgttttatgtttctcacccaaacttttcttctcacatactcattcatcttttaaaagattgctatatagttattgtgtatatatttggtggcttatcttaaacctttttggagacaggtaggatatacattattcagaaaaaaaaaagtaaaagaaatatccctagagcaatgtttttcaaactttattgacttgagctcactcaggcagtttaaaagacacccgtatacatttctgcatggaaaaaattaacttttgttttaacaaaaagagagggacaaaataatgtaaaatatactaaagtgtgtagacatattcagtacactaaagagctttattttcccgtaacatcagtggtaggggaaatggtaaggttttggataagaaccttagagaagacttactattttgggtcagttggccaatcttaaaatgtggggattttaaagaccatcttgttctgatttattcccagagacattatcagtaaactaaaagacaaactatattcaaaaacgaaatggtcagtgtgtttatcagtggactactctcattaaaagtgaggcttacataatagaaaaaatatcactctaggaattctaaggggaagaaaggaaaactgtggggctagaggagtacttttagaaaatatcacagaaatttctggttaaaaagtactactaacatttcctactaatgttagtgttcagttttatctgaaaatcctcagtgatacatatttacattttttcctaaggcagccattgcctatttgggcaattataagagtcagggtgatctcttactttctcttaagttcttccataaaattgaaaccta

SEQ ID NO: 10853 - DNA, 758 bp, Homo sapiens
gagggcggtcgaccttatactagtaattcccaattatgggcagtgttgtccctcggggatgtttgacaatatctggagatgcttttggttgtcaaaagattgagaaaccctgctgttggccaggcatggtggctcacacctgtaatcccacactttgggaggctgaagtcaaaggattgcttgaggccagatattcgagaccagcctgggcaacatagtgagaccctatttttagaaaaaatagataaataaaataaactacaggtcacgtggtggtatgcgcttgtggtctcagctacttgggcagctgaggtcacaagattgcttgagcccaggagtttgagcctacagttagacctgtgattgcaccactgccctccagcctgggtgacagagcaagaccctgtctcaaaaaataaacaaaaaaaaaaaaaccctgctctatactgttctgtgtggtcctatgggagtcctcaaatgcagcagcgttgatattaacagctggcatttactgagcatttacttggtgcttggatttgttctaaacacttccacgtgttttaacttattttatccttgcagcagtcctgtgaggtaggagttaatatttccctcattttggagatacagaaattgaggcccagagaggttgagtcagttgccaaaagtcacacagctaatacatggcagcattggcattgaacaaggcagtctggctcaggagctcacgctgttatccactgtgctacgcagtatgt

SEQ ID NO: 10854 - DNA, 643 bp, Homo sapiens
aaggagaaagataggggtatatccagccaggcgtggtggctcatgcctgtaatcccagcactttgggagggcaagactggtggatcacctgaagtcaggagttcgagaccagcctccagcctgtaaattttgtaaagatacaaaaattaaccaggcatggtggcgtgcacctgtagtcccagctactcgggaggctgagacagaagaactgcttgaacctgggagatggagattgcagtgagccaagatcacaccactgccctccagcctgggtgacagagcaagaccctgtctcaaaaaataaacaaaaaaaaaaaaaccctgctctatactgttctgtgtggtcctatgggagtcctcaaatgcagcagcgttgatattaacagctggcatttactgagcatttacttggtgcttggatttgttctaaacacttccacgtgttttaacttattttatccttgcagcagtcctgtgaggtaggagttaatatttccctcattttggagatacagaaattgaggcccagagaggttgagtcagttgccaaaagtcacacagctaatacatggcagcattggcattgaacaaggcagtctggctcaggagctcacgctgttatccactgtgctacgcagtatgt

SEQ ID NO: 10855 - DNA, 517 bp, Homo sapiens
ggtctgcagggagctgtcatgtcctctgataacaatgccttcttctggaatacctcctgaaggacccctggaggctgtttcacagttaaagttttttctttttaataagcagaaggaatacactaatgattaaaagtaaatatataaaccagttacatagtcatttgttatcattaccaagtattatgtactgcacataattgtatgcactgtacttttatatgactggcagcacactaggtttgtttacaccagcatcaccacaaacacatgagtaatgcattccactacagctacaacatcaactgccaatagcaatttttcagctccattataatgtcatgagaccatcatggtatagacagtcagtcatttacgaggtccttcgttaaccaaaatgtccttatgtggtacatgactctctatgcacgtgtaaacatatatctgtgtgtctttttgcaagcttaaaaaaaaagtatgaaaggattcccactgaaaatccccccgagaagttcag

SEQ ID NO: 10856 - DNA, 378 bp, Homo sapiens
gtgaacgacggcaggaatcgagctcggtaccaccactcctatagatcagattggactataattgtatgcactgtacttttatatgactggcagcacactaggtttgtttacaccagcatcaccacaaacacatgagtaatgcattccactacagctacaacatcaactgccaatagcaatttttcagctccattataatgtcatgagaccatcatggtatagacagtcagtcatttacgaggtccttcgttaaccaaaatgtccttatgtggtacatgactctctatgcacgtgtaaacatatatctgtgtgtctttttgcaagcttaaaaaaaaagtatgaaaggattcccactgaaaatccccccgagaagttcag

SEQ ID NO: 10857 - DNA, 182 bp, Homo sapiens
atggcgggaagatataaaaaataaaaacatatccaggcttaaacacaagaaaatgaccactaggtgggctggaatttgtgaagaatacttaataagacagaatgcatttgcagtgagcttttaagtgtgagttaggatcttgagagttaaaggagaagaaagccttcaaagtgaggagcagg

SEQ ID NO: 10858 - DNA, 375 bp, Homo sapiens
actttctacagcaagtctcctgtgtgagaccaggacctcttcccagcattctaaatgcaagacatctcaacagcccagcatgtcagagtggcatcccgtaggatgtctgctttctctcatcagtcctggagtcgcacctcagagaatgcctgtgagcagcatccgacagagactaccaacaaactggcccaggcatctggcaccagagaaaaatgaactcccagtagacagttccaccacgtgacattttcatgattgacagccctctcccactttccctagcctggcttacatgttgagaaggtaggattccccattacgagaggaggtggtctctgagcaaccacagtgatgtttccattctggagacttact

SEQ ID NO: 10859 - DNA, 342 bp, Homo sapiens
gaatgagctggggcagagtgaattgggcagccttccatcttgacagcacaccaaaatgtataaattagcaaaagcccatctttccctaatgccactaagctgtcagtttctggaattatcatcattattaaattcataatggttttaatgaaggtgtcatccaaactgacactttgaaaataaagtgagatgatgcctaaattggaggcttggaatgaccttagaaaactgctccaggaaacttgagaatgtcccaattacttaaagaactctgagtcagctacatggctcattccattcatttgctttgcattggagagatttatttggattgacaccggt

SEQ ID NO: 10860 - DNA, 632 bp, Homo sapiens
ttctagttaattaggtttttttcaaatataaaactacatcatctgcaaacaaagatataatttgacttctttctttccaatttggatgccctttatttttttctcttgtcaaattgttctggctggcacttccaatactatgtcgaataacagtggtgaaagtatgcatcttttgtgcctcttcttttgtcttcttcaggtgcagacaccttatcagaatgcccttgggtttaggttcccaatttcacaaggtaattcatcctcatacatcctattgtcttttcctggtcctaggtttcagaactgtctgggaagaccacagatgcctatggtggccatgtctcttggaatgtctagggaatgacagctactgcatcacatcctcatggtgggcagcctgaggtatagggtagaggcctcacgggagcagctgagtgccctgatgctaaagcactcttcttgtttacttttcatccaaaacaccaaatccttatggcattaagattttctttctccaaatccagtttccatgttttagagacacattgctggtcagccaatggaaagctgatattgatgggaaaggcagaaataattcctaccatctggattttttcagaattgtggaaggg

SEQ ID NO: 10861 - DNA, 572 bp, Homo sapiens
tttcttttttcttgacatggagtctgactctgttgtccaggctggagtgtaatggcatgatctcggctcactacaacctccctcctgggctcaagcgattctcctgcctcagcttcctgagtagctgagattacaggcacccacaaccacccctggctaatttctgtacttttagtagagatggggtttccccatgttggccaagttggtcttgaactcctgacctcaggtgatccgcccgcctcagcctcccaaagtgctgggattacaggagtgagccaccgcgcccggctgaatttcatcatgttttaagaaagtttactaatttgtattgggctgcattcaaagccctcctggcgcgcacgcaaccagcaggccacaggttggacaagcttgctctagagcatagcctcaaactatcacccagccaaagtgtcactcaagtccagaaacaagggcaaacactggcaaatgggaaaaaacattcagaaaataggacactgacattatggagggaaaaaaacaggagtccagccaaataagagataaaatactctggattggggccggat

SEQ ID NO: 10862 - DNA, 703 bp, Homo sapiens
gcagtttttgccattggaagctgaggcgcaatgaatattcttgtaatgtgtctcttggtgtaaatatgcatgaagtttgtaactagacgtagaattgtagcagttctcagaacgtggtctctagaggatgcctgggtatcctaaaaacctattcaagggtttaatgaaattaaaatgattttcataataatgccaagatgttaaatgtctttttcattgagttgacatatgcacaaatggtacagaagtaatagtgagttaaacggctggcaccttagcacaaatcaaagcagtaatgctggttgtagttgtgatcattgtattctttttctttttcttttcttttttttttttttgagacaaggtctcactttgttactcaggttggagtgcagtggcatgagcacaatcactgctcactgcggcctcggtctcctgggctcaagtgatcctattgttttctttctcgtcatgtacttccaggaaaagaaaaaagccaattcgagtcacttattcttttgattctttttcgtagcaaagcatcaatgcattttctaaatgattgaattcatttaaattcgggaaacatttactgagtgcctatggaattctgggatatgagtgtatgtttaaggcagtgtgatttccagttaccatcctttctgttctaaacacgattgtgtcatattaaaatataaaaaga

SEQ ID NO: 10863 - DNA, 1054 bp, Homo sapiens
tatttatttattgagtcaatttgttcaggtaagtactggggggcttcataagtcatgaggatgtttttatatataaatgtagcaaacatacattacagttcttactgtgtaatcgatgctccataataattcacaaatattcctgctggagcttagtttgtaatttcaagtcagaaatgaaagatatcagtggtgaagaaataagattgattcttcatatggagtggacattttttccagactataaaactgaatcttgctgaatttaaagagaaattctggccgaggcagatggatcacctgaggttaggagtttcagaccagcctggtgaaacccggtctctactaataaactacaaaaattagctgattgtggtggcatccacctgtagcccagctactcaggaggctgaggcagaagaattgcttgaacccaggaggcgaagattgtggtgagccgagattgtgccattgcactacagcctgggtgacagaatgagactcataaaaaaaaaaataaattctgcttcttttattttctacttctcttcagatttgtttctcgtatgtattttccaactatgtatgcatcacagcccttctttttctgagttatagctacagttttctgactgttctcttcacgccatttcatttcgcctggtattttgtagattttgatgacaaaattctatttttagtgcacttaaaaatggattttaactggtgagttcgcttatcaatataacattcagattagttaattaagataaaagccaggtgtggtggctcacgcctctaatcccagcactttgagaggccgaggcaagtggatcacttgagctcaggagttcgagaccagcctgaccaacatggtgaaaccccgtgtctactacaaatacaaaattagccacatgttgtggcgcatgcctgtaatcccagctactcgggaggctgatgcgggagaatcgcttgaacccgggaggcagaggttgcagtgagccgaaattgcgccattgcactccagcctggacaagagcaaaactctgtctca

SEQ ID NO: 10864 - DNA, 1163 bp, Homo sapiens
  misc_feature (1163)..(1163): n is a, c, g, or t
tatttatttattgagtcaatttgttcaggtaagtactggggggcttcataagtcatgaggatgtttttatatataaatgtagcaaacatacattacagttcttactgtgtaatcgatgctccataataattcacaaatattcctgctggagcttagtttgtaatttcaagtcagaaatgaaagatatcagtggtgaagaaataagattgattcttcatatggagtggacattttttccagactataaaactgaatcttgctgaatttaaagagaaattctggccgaggcagatggatcacctgaggttaggagtttcagaccagcctggtgaaacccggtctctactaataaactacaaaaattagctgattgtggtggcatccacctgtagcccagctactcaggaggctgaggcagaagaattgcttgaacccaggaggcgaagattgtggtgagccgagattgtgccattgcactacagcctgggtgacagaatgagactcataaaaaaaaaaataaattctgcttcttttaaaaaaaaaaaaaaaaaaaaaaaaaaaaaaaaaaaaaaaaaaaacaacaaaaaaacaagaaaaaacaaaacaacaaacaaaagcaaacaaaccgcaagcaaaaaacgacagcggcgggcggggccacaaaatatacttctccagcgggggggcccacaacatccacgccaccagtctataattgtcagaacagcgagccactcacatgagtgatttcatcaacagccggcagcaggcgccgacacacaaacgctatacacagcaaaccaactaccatgcgctcagtgcgacagccccttcggagcgggggtggaaaagaaggcacacccaaccagaagatagagacgcgacggggtaaaaaaacacactaggtaggtgttaaggagggcaacacccgatcgatgcgcttgcgagagacgttgcgtgccggtctttccacaaatatgccgtgcgcggacgaaaataaacgaaaaaaaaatcaagaaaagagaggcagagaggcagcgacaagcgtagaagagaagtacaccagaaaacacgagaaacgcaagcgaaagacaaagcagactacgcaatcgacacatagtagagagatgtcgccacggtcaacaagaacgacactacgcacn

SEQ ID NO: 10865 - DNA, 703 bp, Homo sapiens
agcgggcggcgcgggcccgcagccgggcgccctgctcagccagcgccagcggccgccgcacccagccgcgccggcgaggacatgggcagccgcggcgcgcccaccccccgcgccgatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgctcgggacaacattagctatggaactaattctgccttaaagaccctggagatgcgccagctctccggtttgggagatcttcgaggaagagtggcaagatgtgatgccagcatagctagactttctgcagagcacaaaacgacctatgaggggctccagcacttgaacaaagaacagcaggctgccaaacttatct

SEQ ID NO: 10866 - DNA, 846 bp, Homo sapiens
agcgggcggcgcgggcccgcagccgggcgccctgctcagccagcgccagcggccgccgcacccagccgcgccggcgaggacatgggcagccgcggcgcgcccaccccccgcgccgatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgctcgggacaacattagctatggaactaattctgccttaaagaccctggagatgcgccagctctccggtttgggagatcttcgaggaagagtggcaaggtaggtgttcaaatgttggggtctctgctcatcaaaaaccattttctataaactccattgtagtggggaatatattaatgaagccccaaagcaaatggcttgcattcctttagtacattccctccctgctttggccataaaatccagtggtaggagttaaacctggttgtgagggtgccatgggtttcttttgttacgcaattggtgttgtcttcctgggaagaaatgatgggagaactca

SEQ ID NO: 10867 - DNA, 1359 bp, Homo sapiens
agcgggcggcgcgggcccgcagccgggcgccctgctcagccagcgccagcggccgccgcacccagccgcgccggcgaggacatgggcagccgcggcgcgcccaccccccgcgccgatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtaaggtttgtgaaagtcaggtggcctatgtccctttccacagaattgctccatgtcaggaggtcacccacatctaactcctacctcccaggcagtactgcatttagaacaaagctgtctgtcttgtctattcttaatgatcgccaaggagacagcttgcagaaatatcctaattaaatttattccagtgtttgataacagttactgttagtgttatgtttaatctaaatttaccttgctgattattaaatgattttattttgtttggctcttaatgaagagagagaagaactagtcgaatagtttcactctataatctttcatatctttgaagacagctattaagtcaattactaaggtcagactctgttgcttcagattaaatgtttctaggtcataatgattatatgtaatacagtttattactcaaacaatttaggcatttggattgctcctcagactcccctttttactgctgtagttttctttgaaatgagaccaataaaaggccaatattgtctatttttagaattggtagatttactgctatttattgagcaatcacagggaccacacagtttagttcagaaagcttcagatcatttagggcttgggtttccctcactacgcaatgttcatatctttcacatgtaatgactgaatatatgaatactaatagatatatggctagattaaggaaaacttttgcttcctgtgatggagattatatctgaattatgcttcctaaaattaaacctcatttcttttttttccattgtcagatttgtatgtatgtatttattttaaccgctttattgagatataatgtaaatgtcacaaaaagtgtaaaattaaatgatttttagtaaattt

SEQ ID NO: 10868 - DNA, 749 bp, Homo sapiens
agcgggcggcgcgggcccgcagccgggcgccctgctcagccagcgccagcggccgccgcacccagccgcgccggcgaggacatgggcagccgcggcgcgcccaccccccgcgccgatgtgaattattaaaaagaaaatggcccaacggagcactgtatttccttctcgtgtcaccaaggaaaggtataatatatggaaaatatgcatctaaggcgagtgagaaccatgccccgacacagccagtccctgaccatggcaccatactcatctgtaagcctcgtggagcagctggaagacaggatcctctgccatgagaaaaccaccgccgccctcgtagagcacgcctttcggattaaagatgacattgtcaacagtttgcagaaaatgcaaaacaaagggggaggtgaccgcttggccaggcttttcttggaggagcatatcagaaacataactgccatagtgaagcaacttaatcgggatatcgaggtactccaggagcagattcgtgctcgggacaacattagctatggaactaattctgccttaaagaccctggagatgcgccagctctccggtttgggagatcttcgaggaagagtggcaaggatgaactccagtctccttagtgtgatccttggtgatgacaccctgttgactccctcttctctctctacccttgcactgtacctttcagcagtgatcaacttttttgttagtccctgaataaaccatgctcttctattgctcca

SEQ ID NO: 10869 - DNA, 447 bp, Homo sapiens
aggaattggcttgtgtgattatggaggccaagaaatcccatgatctgagggtccaagaaagttggagatgtaattctcgcctgagtgcagaggcctgagaaccaggggagctgatgaatctaaaaaaaggagagagctcaggtacatacacagagaattaaacagtgcttaccatggtcaggggttggggggaagaaatggggggatatagatcaaaggatacaaaatagatatctaggatcaacaaggccagagatctaatacagaacatgaggactaaagttaacaaaattatatttatcagggagttttgttaagtaattagattttaactgctcttgtcacacacacaaaaaaggtaactcttttactatttgtgtcctataacatcatgttgtgaatctcaaatatgtgaaataaaatttattgaagaaaatttaaaaggct

SEQ ID NO: 10870 - DNA, 368 bp, Homo sapiens
caaaaggaagaaaaaagtcatgagtatattaattgtggtaaaagaagaatttgaaaaaatcgaacaatcttccatgataaaaaacactcagcaaactaggaatagaagaaaactatctcataataaaaggcatgtatgaaaaatacactgtgagtaacataatggtgaaagactgaaagcttttcctcaaagaaaaaaaattgcaagaatgcccattttcaccacttctattcaacatagtattggaaattctagccagagcagttaggtaagaaaaagaaataaaactatcccaaatttaaaagacagtagtgaaagtatctcttttcacagatgacatgatcctatatgttgaaaaccctacagat

SEQ ID NO: 10871 - DNA, 271 bp, Homo sapiens
ctgctgttgttaagcatgcctcagattcactctccttcacagtgcagctctgtctttccagcagacagtttccatccaaaggcaaagtgaatcttagaaaccgggaaaaaaagactctaaaagatgacatttaaaatataatagtaagatctaaccaaacatcagactcttcttgtgttgccttaaaggacacacacacacacacacacacacacacacacacacacacgctttctctctctttcatgtagtgaggggggaagagctggct

SEQ ID NO: 10872 - DNA, 452 bp, Homo sapiens
ctctggctaaatcttaaaaacacatctacttctatgccacagtatttgtcaataatctggggacagagaaaaagacattctgaaataaggggtcagagctgtagcagaaaatgtacatccttatttttcaggaatttatagagaaaggctactgttatgtgtgatgatacaaaccccagtaagagaggccaggctcttgcctataatcccagcactttgggaagctgaggcgggagaattatttgagcccaggagttcaagaccagcctgggcaacatggggagaccctgtctctacaaaaagttagccaggtgtggtagcgcatgcctgtggtcccagctactcgggaggctgaggcgggaggattgcttgagcccacctcaaggtgggtgcagtgagccatgatcgtgccactgcactcctgcctgagcaatgaaggaagaccctgtctc

SEQ ID NO: 10873 - DNA, 454 bp, Homo sapiens
gaacaaactatgagaaccacttccagccactgcttctgcacacttctctgctaagtgagtctctgctgtgtgagtctcattggtaaaactaccctgatctaacattctgttacctcctttgtggtccaacactccaagagtccatggcctcagacgcccctgggtttctgctgatgtaaattggcaaaaacttgcattcagtgtgtatgtggctcctcttgggtctcactgtgtgtttatccctctgcacccaactctagtcatggctctgggaataatgagggtcggtggaggtggatctcaagggagatctgtcatcttgcaaggctgtttcctcaagtgaagccatcacagatctttgggcacagttttactcacctcagactctaaggaagggtcacttctgcttacagggagactcaggaaggtctaatgttcaggggactcagagtca

SEQ ID NO: 10874 - DNA, 361 bp, Homo sapiens
ctgggactacaagcacccaccaccatgcccagctaatttttttgtatttttagtagagacggggtttcaccgtgttagccaggatggtctggatctcctgacctcgtgatccgcccatctcagcctcccaaagtgctgggattacaggcatgagccaccacacccagctgattattttccattataccaccagcctctttagctcacgtgccaatgtgaattcaaggccctaacagatggtcaaccacaaggtggattttcagaacacacatgaaaaaaattccttccactataactttttttttttttaagatggagtctcactcttgttgcccaggctggagtgcaatggtgtgatctc

SEQ ID NO: 10875 - DNA, 924 bp, Homo sapiens
cacaactcaacccttccaaacttttttcttcccagcaaggaaggtgaaagcccatccttctgtcttctcttttcttcagctgtgggaccatccacccaggcttcctacatacaattcagcccctccctgtccctccttccactcctccagttcaggtgcattttctcatctctatcttgatttctgacatagctcctgagtggtccagctgccaaaagtcttactcttcccatatcctcttaccatctgtctgaaattcaaatctgactgtgtcattccctttctgagacttaccatcaccatagggatgccattccataacatctgcaatcccgaccagatgttccattatcaggcttccatatttgtcattgctatctcccattatgcccggcattgcactttgtacttgagtaatatagaactatgtgtagttttcagaaatatcatgctgttccatacctggtgcctttggttacaattttttcctctacctataaaactctaccccagtgattttcaaccagggacaattttgtcccttgaagagacagttggcaacatctgcagacatttttgtttgtcataacttggggaggggtgctactggcacatagtgcatagagtccaagaatgtcacccttccataacaaagaattatctggcccaaatgtcaatattgccaaggttgattaaccttcctctacctcttcatttccagtaggataatttctactttccgattatgatttaggtaagactttctcttctttagcaaattgttcatgatccttccttttgtaggattggggaagtagccctttgctgttctatgaaagtgttctctgtgtatacctataccatattttcataggccatatgttattataattttttatttttaataaagaaaatacaagtgtt

SEQ ID NO: 10876 - DNA, 952 bp, Homo sapiens
  misc_feature (624)..(624): n is a, c, g, or t
cggtccggaattcccggatcaagaggagaggcgaggcggggagcgcaagcggcggcggccactgccacgtattcccggcagtggtggcggcggcggcggcggcgcccgcgggcaggaataactcaagtcacctgtactggaaatcagtttgctgaaattaatcaacgattcttgaagttgaagaaaagttgttctctctacaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtactgcccacgctggccgtggtcgtgctcttgatcgtggtgtttgtgtacgtggccacgcgccccaccatcaccgagtgagccccgcagccggccgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgcntttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcctctttccaacacgtgttcacaatctccaaagggactgtatttcttctctgtgcttaatgtgatttgaaatatgttgaatcaa

SEQ ID NO: 10877 - DNA, 992 bp, Homo sapiens
cggtccggaattcccggatcaagaggagaggcgaggcggggagcgcaagcggcggcggccactgccacgtattcccggcagtggtggcggcggcggcggcggcgcccgcgggcaggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtactgcccacgctggccgtggtcgtgctcttgatcgtggtgtttgtgtacgtggccacgcgccccaccatcaccgagtgagccccgcagccggccgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaaaaaa

SEQ ID NO: 10878 - DNA, 1990 bp, Homo sapiens
ggctagtcacacatgcatggaagctggtgatgcagaatgctggggggtggcgagttcatctggagactgtgccagcagccacatctagtttttgggggtggtcatggtggctcggcacctcctgctccagtgcccatgtccagtgctgacggtggtgatgcaggctctggcatcctcacactgggagtgtgagttgggctccagttatggcagcacagcataatgtcctgcccattttctgagcctggttctttggcttttctgggaatcagtgagatgccaaaggcctttaagtaaactcgatttaaatcagctgaagtctgtttcatctgcttaaagctaagaagccgacttttatagagatgttcctctgtagttatccaaacatttgtattcattcttctggcccctgaaagttctacttcacctgttaggcacctccgtgagctacagaattaacaggagaatcccaggttgagtgggtggcaggactgtgggctcagccgtctcccttcattattactgtgacccgggtctccatcatgccccctagacggtgacctctgtggggacacaactgagtccttcatctctatcctcagctccttgagtaatgcttggcacacggtgggtgcttgggaaggtttggatgaatgggccaaggaaccaacaaagagatgagagaagttgatgcctgtgggctctctgcagccttaatgaggctggcctggcttgggcaggaagggggctacgtgcctggagactgcaggctgcctgcagttccatgctggagatgggctggggagatcatggaacttagagcaggaaagcaagtagctagagccacgaaagggagagccgctcctctgagtggaggcggcgtagttggtgcttcccaatcctttcacctcatggcatgtacagaacacagtattatttgtctggtacccagggctttgtccagctggcgctggagcggaggcccctctcacagcacaccggtgacccagtgcccactacttagagcgctgatcccaagagaacttagagcctggtgtggcctctgttcttagccctttgtcatgtaagttgcagatatttttcctagttgtgtatttgcctttaagtgatttattttttcttctatttggtttattctctactatcacagttgttctctctacaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtactgcccacgctggccgtggtcgtgctcttgatcgtggtgtttgtgtacgtggccacgcgccccaccatcaccgagtgagccccgcagccggccgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaaaaaa

SEQ ID NO: 10879 - DNA, 847 bp, Homo sapiens
cgcccgctctgtgccaagccctgagttatacagcttcctactccatcctcaccacggtcccgcgaaggaggttccagccttggcaagaggagtgtggcccttcctggaatccctctaggaaagatgcggcagctcaaagggaagcccaagaaggagacctccaaggacaagaaggagcggaagcaagccatgcaggaggcccggcagcagatcactacagtggtactgcccacgctggccgtggtcgtgctcttgatcgtggtgtttgtgtacgtggccacgcgccccaccatcaccgagtgagccccgcagccggccgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaaaaaa

SEQ ID NO: 10880 - DNA, 858 bp, Homo sapiens
cggtccggaattcccggatcaagaggagaggcgaggcggggagcgcaagcggcggcggccactgccacgtattcccggcagtggtggcggcggcggcggcggcgcccgcgggcaggaataactcaagtcacctgtactggaaatcagtttgctgaaattaatcaacgattcttgaagttgaagaaaaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtactgcccacgctggccgtggtcgtgctcttgatcgtggtgtttgtgtacgtggccacgcgccccaccatcaccgagtgagccccgcagccggccgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgctttcttgggagggaataggggatgttttatcagtgaatgtgccatacaccttatggtccacttcatgtgcctttcagacttcaaagcgcgcgcgcatgtgtgtgtgtgtgtgagtctgttagattagtatctttatttatctttatactatatattctactactttatcaagactcttgtcagggtttcttgtaatctatctagttttattaattacatactataaccttactgtactaaggtactaatt

SEQ ID NO: 10881 - DNA, 895 bp, Homo sapiens
  misc_feature (548)..(548): n is a, c, g, or t
tggtctcacctcttcaaagacctaatcagcgtctagtgggaataactcaagtcacctgtactggaaatcagtttgctgaaattaatcaacgattcttgaagttgaagaaaagttgttctctctacaggaggttccagccttggcaagaggagtgtggcccttcctggaatccctctggacacaccctcctagcatcctctaggaaagatgcggcagctcaaagggaagcccaagaaggagacctccaaggacaagaaggagcggaagcaagccatgcaggaggcccggcagcagatcactacagtggtactgcccacgctggccgtggtcgtgctcttgatcgtggtgtttgtgtacgtggccacgcgccccaccatcaccgagtgagccccgcagccggccgcggaccccatcggcagggagaggaggcgcgggagggggacgcaaacaaaaaatggctttcatattcagagatgttcatgttgctgagctgtaagcaggagcaccctgtcttctctggtctttgacttgattaaagtatctccgcntttcttgggagggaataggggatgttttatcagtgaatgtgccatacaccttatggtccacttcatgtgcctttcagacttcaaagcgcgcgcgcatgtgtgtgtgtgtgtgtgtgtgtgtgtgtgtgtgcttctttttctctcctaaaaatcgataagtagctccacctgaagagggatggaacctctgggtcaggaaatgttgagtctcatccactaaccgtgggtggatgcgcctcagactgtccactcccgggaggatacgccggctagggtcgcatttgccacgaatttttgcaagaaaagcctcgggggccgccctacgtcggtactgtacgccgttgccg

SEQ ID NO: 10882 - DNA, 379 bp, Homo sapiens
ttaagatgatcatacgggttttgtttttaattctgtttatatggtggaccacatatgtttgcatatgttgaaccatccttgcatcccagagacaaagcccatttgattgtgtgtgtgtgtgtgtgtgtgtgtgcttctttttctctcctaaaaatcgataagtagctccacctgaagagggatggaacctctgggtcaggaaacagctggaatccacactcacctcattcccattgtttggatcatgcttctttccaacacgtgttcacaatctccaaagggactgtatttcttctctgtgcttaatgtgatttgaaatatgttgaatcaaagtgaaatatttattttttgaataaaggagataatagccttaaaaaaa

SEQ ID NO: 10883 - DNA, 2064 bp, Homo sapiens
cgatttaatctttacataaaagctgtacatataaccaagaagttatttttgccagtaaattaacttatttgctttattcatcttatttggttcctaatcgtaaatattttgtagctgctgtaaatttttttctcccaaatgaggagtcttattatcataaaggtaaaggctattcagctttgataaccacctgcaattcttttttggatcattcatccatctaacaaatacataatgaggacagttcatgttaatgaaaatccatgttgtttaatagaatgccatcctttacctacttttgctctgtatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaacgttcaaaaaag

SEQ ID NO: 10884 - DNA, 3022 bp, Homo sapiens
agcaatcttggggcaggggccattttggaagcatgttgcgaggctccgcttcttctacaagtatggagaaggcaaaaggcaaggagtggacctccacagagaagtcgagggaagaggatcagcaggcttctaatcaaccaaattcaattgctttgccaggaacatcagcaaagagaaccaaagaaaaaatgtctgtcaaaggcagtaaagtgctctgccctaagaaaaaggcagagcacactgacaaccccagacctcagaagaagataccaatccctccattaccttctaaactgccacctgttaatctgattcaccgggacattctgcgggcctggtgccaacaattgaagctgagctccaaaggccagaaattggatgcatataagcgcctgtgtgcctttgcctacccaaatcaaaaggattttcctagcacagcaaaagaggccaaaatccggaaatcattgcaaaaaaaattaaaggtggaaaagggggaaacgtccctgcaaagttctgagacacatcctcctgaagtggctcttcctcctgtgggggagccgcctgccctggaaaattccactgctctccttgagggagttaatacagttgtggtgacaacttctgccccagaggctttgctggcctcctgggcgagaatttcagccagggcgaggacaccagaggcagtggaatctccacaagaggcctctggtgtcaggtggtgtgtggtccatgggaaaagtctccctgcagacacagatggttgggttcacctgcagtttcatgctggtcaagcctgggttccagaaaagcaagaagggagagtgagtgcactcttcttgcttcctgcctccaattttccacccccgcaccttgaagacaatatgttgtgccccaaatgtgttcacaggaacaaggtcttaataaaaagcctccaatgggaatagaatatcaggaaaaaggccacatctatggtaattaatggcagaaaagctggagagttggattctgcggtgctgctgacaggtgaactctggtcctctgcacctgtttatgggccatgcagactggtggggtggcagatgttagcctaagacccctagcagtgcctgttgctttgtgagtggagatagagactcttacatttaaaaatggaaaaacatttcacaaattaccataaattgtagttaatatgtagaaaaactcattcatactacttttctaaaatagacatgacttcagcagcagcttttttttgttgtattttgagacagtgtctcactgttgcccaggctggagtgcagtggtgcaatctcagttcagtgcaatctccgcctcctgggttcaaatgattctcctgcctcagcctcttgagtagctaggtacaggcacctgccaccacacccagctaattttttgtatttttagtagagatggggtttcaccatgttggccaggttggtctcaaactcctggactcaagtgatcaccctcctcagcctcccaaaatgctgggactatgggcatgagcccctgcgcctgaccttcaacagctcttttaagtgagttcttcagctaagcattgtgatggacttgagtaaaatggtagttggctcttgtgctcaattttctcttcctctgaacactgactactttaggagctgcttcattccaattgcaatttcataaaacgtaaagtattttaaggcaaagaaaggctgttaattccctccctcccccaaacacatgatttttaatattctaaacaatatttttcaaagttctcttaataacctgagatttctatggtttgactccaggatcaaaacacaagggactttgtattatttcacttataattgttttgtatatttctggagtttaaaatgtttaaggttgcttcccgctcataaatacataatatattgaatttaaaatgtgtttattaaccgattctccataaataaaaataagatgtgtatgtaaaataattcatctgttgtatttagagaaccatattcattgcatgcaaattttattgttagtgttcttaactcaagtaggagtaaaccaaaaagtgtgatttttcttttgtatgactcgtttgttctttattagttggtggtatgggttggatcatttgtttttaaaactacttaggtatgattcacatacaaaaagctgcacatatttaatgtatcctattgtgtaattaatttttaatttttttgtgtacttcctaaacttatagtcctgcgagtctgggaacagatctgtttttcacttatcctgatttaatgacagtttccaacattgttttgttattacaagtaggggatctttttttttgcccgtttaatgaagatactaaaaataatgcactggaaggagtggaagagttggaaaatttgtaaccatcataatacaggtgtaataggtttgggaaagaatcctcaaaaatgttaaagcaagggaggaaagtttgttgagaagcaagatgttcttctctcctgcccgcccccgccgttggttgttggtggtcagaattattgtgtaataaataatagacattttttcttatactatgtgtattgttccttttgtttcctttttaaacttctcccctgctttatttggatgggtcaagtttctgttctgtttccttcctttctattaatttggaaatgtccttggctttacgattctgcttgtagatacttcccctgtttctaacacatttcaataaacttaaatttctctatatacaaaataaattaataattggagtctaccagtaagacagtttatttactcatcttcctgccccagcaagataaaaccttaaggttacatacttgccaaatcaccctaattttcacaggcctcccccaaagttcctatcaatcacattcagtcccccactccctgtctccctgctatgctcccagaatgctaagaggaagacagttggagctataaactccctgtgtctcagatgagttccctggcagaggcatgacat

SEQ ID NO: 10885 - DNA, 2580 bp, Homo sapiens
agcaatcttggggcaggggccattttggaagcatgttgcgaggctccgcttcttctacaagtatggagaaggcaaaaggcaaggagtggacctccacagagaagtcgagggaagaggatcagcaggcttctaatcaaccaaattcaattgctttgccaggaacatcagcaaagagaaccaaagaaaaaatgtctgtcaaaggcagtaaagtgctctgccctaagaaaaaggcagagcacactgacaaccccagacctcagaagaagataccaatccctccattaccttctaaactgccacctgttaatctgattcaccgggacattctgcgggcctggtgccaacaattgaagctgagctccaaaggccagaaattggatgcatataagcgcctgtgtgcctttgcctacccaaatcaaaaggattttcctagcacagcaaaagaggccaaaatccggaaatcattgcaaaaaaaattaaaggtggaaaagggggaaacgtccctgcaaagttctgagacacatcctcctgaagtggctcttcctcctgtgggggagccgcctgccctggaaaattccactgctctccttgagggagttaatacagttgtggtgacaacttctgccccagaggctttgctggcctcctgggcgagaatttcagccagggcgaggacaccagaggcagtggaatctccacaagaggcctctggtgtcaggtggtgtgtggtccatgggaaaagtctccctgcagacacagatggttgggttcacctgcagtttcatgctggtcaagcctgggttccagaaaagcaagaagggagagtgagtgcactcttcttgcttcctgcctccaattttccacccccgcaccttgaagacaatatgttgtgccccaaatgtgttcacaggaacaaggtcttaataaaaagcctccaatgggaatagaatatcaggaaaaaggccacatctatggtaattaatggcagaaaagctggagagttggattctgcggtgctgctgacaggtgaactctggtcctctgcacctgtttatgggccatgcagactggtggggtggcagatgttagcctaagacccctagcagtgcctgttgctttgtgagtggagatagagactcttacatttaaaaatggaaaaacatttcacaaattaccataaattgtagttaatatgtagaaaaactcattcatactacttttctaaaatagacatgacttcagcagcagcttttttttgttgtattttgagacagtgtctcactgttgcccaggctggagtgcagtggtgcaatctcagttcagtgcaatctccgcctcctgggttcaaatgattctcctgcctcagcctcttgagtagctaggtacaggcacctgccaccacacccagctaattttttgtatttttagtagagatggggtttcaccatgttggccaggttggtctcaaactcctggactcaagtgatcaccctcctcagcctcccaaaatgctgggactatgggcatgagcccctgcgcctgaccttcaacagctcttttaagtgagttcttcagctaagcattgtgatggacttgagtaaaatggtagttggctcttgtgctcaattttctcttcctctgaacactgactactttaggagctgcttcattccaattgcaatttcataaaacgtaaagtattttaaggcaaagaaaggctgttaattccctccctcccccaaacacatgatttttaatattctaaacaatatttttcaaagttctcttaataacctgagatttctatggtttgactccaggatcaaaacacaagggactttgtattatttcacttataattgttttgtatatttctggagtttaaaatgtttaaggttgcttcccgctcataaatacataatatattgaatttaaaatgtgtttattaaccgattctccataaataaaaataagatgtgtatgtaaaataattcatctgttgtatttagagaaccatattcattgcatgcaaattttattgttagtgttcttaactcaagtaggagtaaaccaaaaagtgtgatttttcttttgtatgactcgtttgttctttattagttggtggtatgggttggatcatttgtttttaaaactacttaggtatgattcacatacaaaaagctgcacatatttaatgtatcctattgtgtaattaatttttaatttttttgtgtacttcctaaacttatagtcctgcgagtctgggaacagatctgtttttcacttatcctgatttaatgacagtttccaacattgttttgttattacaagtaggggatctttttttttgcccgtttaatgaagatactaaaaataatgcactggaaggagtggaagagttggaaaatttgtaaccatcataatacaggtgtaataggtttgggaaagaatcctcaaaaatgttaaagcaagggaggaaagtttgttgagaagcaagatgttcttctctcctgcccgcccccgccgttggttgttggtggtcagaattattgtgtaataaataatagacattttttctta

SEQ ID NO: 10886 - DNA, 299 bp, Homo sapiens
  misc_feature (15)..(15): n is a, c, g, or t
cgcggccgcgcgacngccgagaagacgacagaaggggggagaaggcaaaaggcaaggaggtcagtacagagtggagttctgtgtgtctttgtgtttctgtcttccctgggcactcctgatttttcctttaaggagaaaagaatgtgccttcgaattttctcctcttgacttttttttttttattttaagagtaaggcccaagaatatgattgcagcctggtatattggagtgagcagacaagtaagaaatgaggttttctaggtttagttgaggaggttgagtgtgtcaaaagatgggc

SEQ ID NO: 10887 - DNA, 2535 bp, Homo sapiens
  misc_feature (2498)..(2498): n is a, c, g, or t
agcaatcttggggcaggggccattttggaagcatgttgcgaggctccgcttcttctacaagtatggagaaggcaaaaggcaaggagtggacctccacagagaagtcgagggaagaggatcagcaggcttctaatcaaccaaattcaattgctttgccaggaacatcagcaaagagaaccaaagaaaaaatgtctgtcaaaggcagtaaagtgctctgccctaagaaaaaggcagagcacactgacaaccccagacctcagaagaagataccaatccctccattaccttctaaactgccacctgttaatctgattcaccgggacattctgcgggcctggtgccaacaattgaagctgagctccaaaggccagaaattggatgcatataagcgcctgtgtgcctttgcctacccaaatcaaaaggattttcctagcacagcaaaagaggccaaaatccggaaatcattgcaaaaaaaattaaaggtggaaaagggggaaacgtccctgcaaagttctgagacacatcctcctgaagtggctcttcctcctgtgggggagccgcctgccctggaaaattccactgctctccttgagggagttaatacagttgtggtgacaacttctgccccagaggctttgctggcctcctgggcgagaatttcagccagggcgaggacaccagaggcagtggaatctccacaagaggcctctggtgtcaggtggtgtgtggtccatgggaaaagtctccctgcagacacagatggttgggttcacctgcagtttcatgctggtcaagcctgggttccagaaaagcaagaagggagagtgagtgcactcttcttgcttcctgcctccaattttccacccccgcaccttgaagacaatatgttgtgccccaaatgtgttcacaggaacaaggtcttaataaaaagcctccaatgggaatagaatatcaggaaaaaggccacatctatggtaattaatggcagaaaagctggagagttggattctgcggtgctgctgacaggtgaactctggtcctctgcacctgtttatgggccatgcagactggtggggtggcagatgttagcctaagacccctagcagtgcctgttgctttgtgagtggagatagagactcttacatttaaaaatggaaaaacatttcacaaattaccataaattgtagttaatatgtagaaaaactcattcatactacttttctaaaatagacatgacttcagcagcagcttttttttgttgtattttgagacagtgtctcactgttgcccaggctggagtgcagtggtgcaatctcagttcagtgcaatctccgcctcctgggttcaaatgattctcctgcctcagcctcttgagtagctaggtacaggcacctgccaccacacccagctaattttttgtatttttagtagagatggggtttcaccatgttggccaggttggtctcaaactcctggactcaagtgatcaccctcctcagcctcccaaaatgctgggactatgggcatgagcccctgcgcctgaccttcaacagctcttttaagtgagttcttcagctaagcattgtgatggacttgagtaaaatggtagttggctcttgtgctcaattttctcttcctctgaacactgactactttaggagctgcttcattccaattgcaatttcataaaacgtaaagtattttaaggcaaagaaaggctgttaattccctccctcccccaaacacatgatttttaatattctaaacaatatttttcaaagttctcttaataacctgagatttctatggtttgactccaggatcaaaacacaagggactttgtattatttcacttataattgttttgtatatttctggagtttaaaatgtttaaggttgcttcccgctcataaatacataatatattgaatttaaaatgtgtttattaaccgattctccataaataaaaataagatgtgtatgtaaaataattcatctgttgtatttagagaaccatattcattgcatgcaaattttattgttagtgttcttaactcaagtaggagtaaaccaaaaagtgtgatttttcttttgtatgactcgtttgttctttattagttggtggtatgggttggatcatttgtttttaaaactacttaggtatgattcacatacaaaaagctgcacatatttaatgtatcctattgtgtaattaatttttaatttttttgtgtacttcctaaacttatagtcctgcgagtctgggaacagatctgtttttcacttatcctgatttaatgacagtttccaacattgttttgttattacaagtaggggatctttttttttgcccgtttaatgaagatactaaaaataatgcactggaaggagtggaagagttggaaaatttgtaaccatcataatacaggtgtaataggtttgggaaagaatcctcaaaaatgttaaagcaagggaggaaagtttgttgagaagcaagncgccaccacacaacgaaagaaaaagaagccggccgcc

SEQ ID NO: 10888 - DNA, 2234 bp, Homo sapiens
ccattctcctgcctcagcctcctgagtagctgggactacaggcccccgccaccacgcctggctaattttttgtatttttagtagaaacggggtttcactgtgttagccaggatggtctcgatctcctgacctcgtgatccacccgcctcggcctcccaaagtgctgggattacaagcgtgagccactgcgcccagcttgtatgcttttctaaaggagaacagaatagagaagaggttaagttaggatttcagggttcacatcttggagctggtcaatcaagggtgatgggccataatgcagtcttacatcagtatgtcatcctggtgtgcgggtacctgtctctttcctttgccattgccaggtggtgtcaggtggtgtgtggtccatgggaaaagtctccctgcagacacagatggttgggttcacctgcagtttcatgctggtcaagcctgggttccagaaaagcaagaagggagagtgagtgcactcttcttgcttcctgcctccaattttccacccccgcaccttgaagacaatatgttgtgccccaaatgtgttcacaggaacaaggtcttaataaaaagcctccaatgggaatagaatatcaggaaaaaggccacatctatggtaattaatggcagaaaagctggagagttggattctgcggtgctgctgacaggtgaactctggtcctctgcacctgtttatgggccatgcagactggtggggtggcagatgttagcctaagacccctagcagtgcctgttgctttgtgagtggagatagagactcttacatttaaaaatggaaaaacatttcacaaattaccataaattgtagttaatatgtagaaaaactcattcatactacttttctaaaatagacatgacttcagcagcagcttttttttgttgtattttgagacagtgtctcactgttgcccaggctggagtgcagtggtgcaatctcagttcagtgcaatctccgcctcctgggttcaaatgattctcctgcctcagcctcttgagtagctaggtacaggcacctgccaccacacccagctaattttttgtatttttagtagagatggggtttcaccatgttggccaggttggtctcaaactcctggactcaagtgatcaccctcctcagcctcccaaaatgctgggactatgggcatgagcccctgcgcctgaccttcaacagctcttttaagtgagttcttcagctaagcattgtgatggacttgagtaaaatggtagttggctcttgtgctcaattttctcttcctctgaacactgactactttaggagctgcttcattccaattgcaatttcataaaacgtaaagtattttaaggcaaagaaaggctgttaattccctccctcccccaaacacatgatttttaatattctaaacaatatttttcaaagttctcttaataacctgagatttctatggtttgactccaggatcaaaacacaagggactttgtattatttcacttataattgttttgtatatttctggagtttaaaatgtttaaggttgcttcccgctcataaatacataatatattgaatttaaaatgtgtttattaaccgattctccataaataaaaataagatgtgtatgtaaaataattcatctgttgtatttagagaaccatattcattgcatgcaaattttattgttagtgttcttaactcaagtaggagtaaaccaaaaagtgtgatttttcttttgtatgactcgtttgttctttattagttggtggtatgggttggatcatttgtttttaaaactacttaggtatgattcacatacaaaaagctgcacatatttaatgtatcctattgtgtaattaatttttaatttttttgtgtacttcctaaacttatagtcctgcgagtctgggaacagatctgtttttcacttatcctgatttaatgacagtttccaacattgttttgttattacaagtaggggatctttttttttgcccgtttaatgaagatactaaaaataatgcactggaaggagtggaagagttggaaaatttgtaaccatcataatacaggtgtaataggtttgggaaagaatcctcaaaaatgttaaagcaagggaggaaagtttgttgagaagcaagatgttcttctctcctgcccgcccccgccgttggttgttggtggtcagaattattgtgtaataaataatagacattttttctta

SEQ ID NO: 10889 - DNA, 2190 bp, Homo sapiens
ccattctcctgcctcagcctcctgagtagctgggactacaggcccccgccaccacgcctggctaattttttgtatttttagtagaaacggggtttcactgtgttagccaggatggtctcgatctcctgacctcgtgatccacccgcctcggcctcccaaagtgctgggattacaagcgtgagccactgcgcccagcttgtatgcttttctaaaggagaacagaatagagaagaggttaagttaggatttcagggttcacatcttggagctggtcaatcaagggtgatgggccataatgcagtcttacatcagtatgtcatcgtgtcaggtggtgtgtggtccatgggaaaagtctccctgcagacacagatggttgggttcacctgcagtttcatgctggtcaagcctgggttccagaaaagcaagaagggagagtgagtgcactcttcttgcttcctgcctccaattttccacccccgcaccttgaagacaatatgttgtgccccaaatgtgttcacaggaacaaggtcttaataaaaagcctccaatgggaatagaatatcaggaaaaaggccacatctatggtaattaatggcagaaaagctggagagttggattctgcggtgctgctgacaggtgaactctggtcctctgcacctgtttatgggccatgcagactggtggggtggcagatgttagcctaagacccctagcagtgcctgttgctttgtgagtggagatagagactcttacatttaaaaatggaaaaacatttcacaaattaccataaattgtagttaatatgtagaaaaactcattcatactacttttctaaaatagacatgacttcagcagcagcttttttttgttgtattttgagacagtgtctcactgttgcccaggctggagtgcagtggtgcaatctcagttcagtgcaatctccgcctcctgggttcaaatgattctcctgcctcagcctcttgagtagctaggtacaggcacctgccaccacacccagctaattttttgtatttttagtagagatggggtttcaccatgttggccaggttggtctcaaactcctggactcaagtgatcaccctcctcagcctcccaaaatgctgggactatgggcatgagcccctgcgcctgaccttcaacagctcttttaagtgagttcttcagctaagcattgtgatggacttgagtaaaatggtagttggctcttgtgctcaattttctcttcctctgaacactgactactttaggagctgcttcattccaattgcaatttcataaaacgtaaagtattttaaggcaaagaaaggctgttaattccctccctcccccaaacacatgatttttaatattctaaacaatatttttcaaagttctcttaataacctgagatttctatggtttgactccaggatcaaaacacaagggactttgtattatttcacttataattgttttgtatatttctggagtttaaaatgtttaaggttgcttcccgctcataaatacataatatattgaatttaaaatgtgtttattaaccgattctccataaataaaaataagatgtgtatgtaaaataattcatctgttgtatttagagaaccatattcattgcatgcaaattttattgttagtgttcttaactcaagtaggagtaaaccaaaaagtgtgatttttcttttgtatgactcgtttgttctttattagttggtggtatgggttggatcatttgtttttaaaactacttaggtatgattcacatacaaaaagctgcacatatttaatgtatcctattgtgtaattaatttttaatttttttgtgtacttcctaaacttatagtcctgcgagtctgggaacagatctgtttttcacttatcctgatttaatgacagtttccaacattgttttgttattacaagtaggggatctttttttttgcccgtttaatgaagatactaaaaataatgcactggaaggagtggaagagttggaaaatttgtaaccatcataatacaggtgtaataggtttgggaaagaatcctcaaaaatgttaaagcaagggaggaaagtttgttgagaagcaagatgttcttctctcctgcccgcccccgccgttggttgttggtggtcagaattattgtgtaataaataatagacattttttctta

SEQ ID NO: 10890 - DNA, 346 bp, Homo sapiens
tgctggtcaagcctgggttccagaaaagcaagaagggagagtgagtgcactcttcttgcttcctgcctccaattttccacccccgcaccttgaagacaatatgttgtgccccaaatgtgttcacaggtaattacctgatgcttttctacaaactaaaagtgggtgccggattttcaattgcagaaagttaagatatacattaatcttaaatagccaggtatttcaagctcaaattgtcagtaaagagtttcaagaaaattattactcagttaagtttatccccaggaaaaagaaagcatttatgtgtcagggtttaatgcttctacctggagacacagaattctgg

SEQ ID NO: 10891 - DNA, 1319 bp, Homo sapiens
agcaatcttggggcaggggccattttggaagcatgttgcgaggctccgcttcttctacaagtatggagaaggcaaaaggcaaggagtggacctccacagagaagtcgagggaagaggatcagcaggcttctaatcaaccaaattcaattgctttgccaggaacatcagcaaagagaaccaaagaaaaaatgtctgtcaaaggcagtaaagtgctctgccctaagaaaaaggcagagcacactgacaaccccagacctcagaagaagataccaatccctccattaccttctaaactgccacctgttaatctgattcaccgggacattctgcgggcctggtgccaacaattgaagctgagctccaaaggccagaaattggatgcatataagcgcctgtgtgcctttgcctacccaaatcaaaaggattttcctagcacagcaaaagaggccaaaatccggaaatcattgcaaaaaaaattaaaggtggaaaagggggaaacgtccctgcaaagttctgagacacatcctcctgaagtggctcttcctcctgtgggggagccgcctgccctggaaaattccactgctctccttgagggagttaatacagttgtggtgacaacttctgccccagaggctttgctggcctcctgggcgagaatttcagccagggcgaggacaccagaggcagtggaatctccacaagaggcctctggtgtcaggtggtgtgtggtccatgggaaaagtctccctgcagacacagatggttgggttcacctgcagtttcatgctggtcaagcctgggttccagaaaagcaagaagggagagtgagtgcactcttcttgcttcctgcctccaattttccacccccgcaccttgaagacaatatgttgtgccccaaatgtgttcacaggaacaaggtcttaataaaaagcctccaatgggaatagaatatcaggaaaaaggccacatctatggtaattaatggcagaaaagctggagagttggattctgcggtgctgctgacaggtgaactctggtcctctgcacctgtttatgggccatgcagactggtggggtggcagatgttagcctaagacccctagcagtgcctgttgctttgtgagtggagatagagactcttacatttaaaaatggaaaaacatttcacaaattaccataaattgtagttaatatgtagaaaaactcattcatactacttttctaaaatagacatgacttcagcagcagcttttttttgttgtattttgagacagtgtctcactgcactccagccgggcgacagagcaagattctgtctc

SEQ ID NO: 10892 - DNA, 1144 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggata

SEQ ID NO: 10893 - DNA, 1032 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccctggcaagtgggagggaggacatgatc

SEQ ID NO: 10894 - DNA, 748 bp, Homo sapiens
gtttccgtagtgtagtggttatcacgttcgcctcacatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatatataaacacaaaaaaaaacaaaaaattttttggggcatggccaaaaagagttaaaacaatgtgggacgcggggca

SEQ ID NO: 10895 - DNA, 297 bp, Homo sapiens
  misc_feature (63)..(63): n is a, c, g, or t
ccactagttattccactcatgctacagtgcaagaggcagtggcactccttaggaaagtctggnaggactccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggata

SEQ ID NO: 10896 - DNA, 2355 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtgaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctgggattacaggcgcacaccaccaatgcccagctagtttttgtgtttttcatagagacagggtctcaccatgtcattcagaccagcctggccaacatggtgaaaccccatctctactaaaaaaatatataacaattagccaggcgtggtggcacacgcctgtaaacccaactacttgggaggctgaggcaggagaattgcttgagcccgggagagggaggttgcagtgagccgagatcatgccactgcactccagcctggctgacagagcaagactctgtctc

SEQ ID NO: 10897 - DNA, 3205 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtgaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctgggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggttaacattagatttgggtgtcttatacactatttaatacgccaatgataaatgccttacaccataagaagaaagctaatcattgagtaaatgggagaaaagagatgattcacgtcactacagttgattcaacctccaacaccaccatgaatatgcataggtttgagcttttagctagattcctgagtgtaaggcatctattttaaaagtgccacaggttggccgggtgcggtggctcatgcctgtaatcccagcactttggccgcccgccgaggcgggcggatcacctgaggtcaggagttcaagaccagcctggccaacatggtgaaaccccatctctactaaaaaaatatataacaattagccaggcgtggtggcacacgcctgtaaacccaactacttgggaggctgaggcaggagaattgcttgagcccgggagagggaggttgcagtgagccgagatcatgccactgcactccagcctggctgacagagcaagactctgtctc

SEQ ID NO: 10898 - DNA, 2861 bp, Homo sapiens
  misc_feature (2713)..(2713): n is a, c, g, or t
  misc_feature (2718)..(2718): n is a, c, g, or t
  misc_feature (2720)..(2720): n is a, c, g, or t
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtgaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctgggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggttaccttaccaaaaanaaaananaaaaaatttttgcggcccgccccgaaaatttaacctctttggcggcccaggaaggaaatgcaggtccacagaacggggagtcgggtcccaaaaacgggcgcgttgaacaggtgggctgttagccaccacccccggggaggg

SEQ ID NO: 10899 - DNA, 1977 bp, Homo sapiens
  misc_feature (1829)..(1829): n is a, c, g, or t
  misc_feature (1834)..(1834): n is a, c, g, or t
  misc_feature (1836)..(1836): n is a, c, g, or t
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggttaccttaccaaaaanaaaananaaaaaatttttgcggcccgccccgaaaatttaacctctttggcggcccaggaaggaaatgcaggtccacagaacggggagtcgggtcccaaaaacgggcgcgttgaacaggtgggctgttagccaccacccccggggaggg

SEQ ID NO: 10900 - DNA, 2544 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtgaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctgggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggtta

SEQ ID NO: 10901 - DNA, 1162 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactaaaacacaatcggtctaaatcagaataacacagactctggacctaaaagacacaacgtc

SEQ ID NO: 10902 - DNA, 2577 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtgaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctgggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggtta

SEQ ID NO: 10903 - DNA, 1868 bp, Homo sapiens
  misc_feature (45)..(45): n is a, c, g, or t
ttttattatagtcaaaaaataggaaagaggggggctattgttacngagagaggtttggagctccacagaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtgaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctgggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggtta

SEQ ID NO: 10904 - DNA, 1202 bp, Homo sapiens
  misc_feature (1094)..(1094): n is a, c, g, or t
  misc_feature (1169)..(1169): n is a, c, g, or t
  misc_feature (1194)..(1195): n is a, c, g, or t
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctccaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcatttaaagaagacactgaagaacatcacctaagagattattttgaacagtntggaaaaattgaagtggattgggaatcatgactgacccgaggcaatggcaagaaaaaggggcttttgcctttggnaaccctttgacgaccattgactccnnggattaa

SEQ ID NO: 10905 - DNA, 965 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcgatcatgacaagatgtttaagatgagtgaaaagatattactcctgtgtgttggagaggctggagacactgtacagtttgcagaatatattcagacagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgattattttacgtgtgagggcagccgtacctcttagcaaatgtctgttcgcagctcctattttcgtttcatcccttatccttactactctacaaatggcccccacattgacataagcttctctcccttttcctgtctcttctctactttaccccattagctctcttaaccctagtgccctcctttctattgtttgtctaatctctctttacttctcttctttttatcctcat

SEQ ID NO: 10906 - DNA, 1406 bp, Homo sapiens
  misc_feature (1152)..(1152): n is a, c, g, or t
  misc_feature (1157)..(1157): n is a, c, g, or t
  misc_feature (1160)..(1160): n is a, c, g, or t
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggataaaaacaanacacnaancacacaaaacgcaacacaaaacgcccgggttcgggcccgcgacctgagccgcccagaaaacacgtcctcacaacacccaccccgtggggaagccggcgcgccccagtaggtggaagggagaacctgtgcgccataacgggatcccaaaggaagaacccggggaccaacacaagccgccggggactccccacccacataaaaaagacccccgggggacaaccgcgagcgtttcgagaacaacccgag

SEQ ID NO: 10907 - DNA, 824 bp, Homo sapiens
  misc_feature (128)..(128): n is a, c, g, or t
gtccagactgaaggaagagaccggaaggggctgattatcgatcaggtattccgcatggtgggctgcggcggctttccggtccaactacggacatgtcgtacatggagtatctgacgaaatcgcatgtnatgtacctcggtcacctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggata

SEQ ID NO: 10908 - DNA, 759 bp, Homo sapiens
ccccagtaccagcccggggagaacctctaggcacaggcgggcccagaccggcttctcggcttggatcctgggctgggtggcccctgtctcggggcttgccccactctgcctgcctgctgttggtcctctctctgtggggctgaattgccaggggcgaggcccttcctctttggtggcatggaaggggcttctggacctatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatacacaaaaacaaaaaaacaaaaaaaaaaaaaaaaaaaaaaaaaaaaaaaacaaacagaaaccagcacagcccgcagaacagaaaacaaacagaacaaggacaacacagaagataagacaacacgagaaagacagagacagaacaaagaaacagaacaacaacaacaggagaggcgcatcatcaaagaaaacgaacgcagaggcaagaaaaagaatcggcaacggacagataagaagaagagaccgaaaaagaaaaaagaataaacaaaaagaagaaaacacgca

SEQ ID NO: 10909 - DNA, 2700 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtgaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctgggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggtta

SEQ ID NO: 10910 - DNA, 2470 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtgaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctgggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgacca

SEQ ID NO: 10911 - DNA, 2488 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctggggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggttaacattagatttgggtgtcttatacactatttaatacgccaatgataaatgccttacaccataagaagaaagctaatcattgagtaaatgggagaaaagagatgattcacgtcactacagttgattcaacctccaacaccaccatgaatatgcataggtttgagcttttagctagattcctgagtgtaaggcatctattttaaaagtgccacaggttggccgggtgcggtggctcatgcctgtaatcccagcactttggccgcccgccgaggcgggcggatcacctgaggtcaggagttcaagaccagcctggccaacatggtgaaaccccatctctactaaaaaaatatataacaattagccaggcgtggtggcacacgcctgtaaacccaactacttgggaggctgaggcaggagaattgcttgagcccgggagagggaggttgcagtgagccgagatcatgccactgcactccagcctggctgacagagcaagactctgtctc

SEQ ID NO: 10912 - DNA, 2486 bp, Homo sapiens
  misc_feature (272)..(272): n is a, c, g, or t
gatgaactaggactgaggagcaagcgagcaagcagcagttcgtggtgaagatggaaaagagtcctggagccagtgcgatttagtgaaggaagctaggaagaaggaaggagcgctaacgatttggtggtgaagctaggaaaaaggattccaggaaggagcaagtgcaatttggtgatgaaggtagcaggcggcttggcttggcaaccacacggaggaggcgagcaggcgttgtgcgtagaggatcctgttgctggcgacacgtgtcgccagcnatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtgaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctgggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggtta

SEQ ID NO: 10913 - DNA, 1129 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttaattcagaataaaggtgactatggatataatttgaacaaaaccacg

SEQ ID NO: 10914 - DNA, 2646 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagacagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataattgagccctctggtccaggtctcagtttacctaatattacctcagaaaggatatggagggaagatgatctttttgccaggtctgacttttcttcctgctccgccctccattaacgctcagtaccctttagcagctgacggccccacgttctactccatgcttggcttcctttccaactagctctttcatatattttacttgctagtatctccattctctctaaagtagtggttctttttgcccttaaacttaaatttttaaattaattaacctgaattaataatacatgcacttaatgtaacatgcaaacagtacaaaaacatgtagtgaaaaatatttcttccagagctgggtgtggtggctcatacctgtaatcccagcactttgggaggccgaggcgggcggatcacgaggtcaagagagcgagaccatcctgaccaacatggtgaaaccccgtctctactaaaaatacaaaaattagctgggcgtggtggcacgcacccctagtcccagctactggggaggctgagacaggagaatcggtcgaacccgggaggcagaggttgcagtgagcctagatcgcgccactgtactccagcctggcaacagagtgagactccgtctcaaaaaaaagaaggaaaaatgtttcttccatccctataatccagtcatctgcttcctgcttcccttcctggaggaaacttcagctactaatttcttatgttttttaagagatattctgttactgtgtaaagtatacatacatacagacacatgccccctttaaattttttagatttatttatttatttagagacagggtctcactctagcccaggctggagtgctgtggcgtaatcttggctcactgcaacctccgcctcccgggcccaagtgatcctcccatctcagcctcctgagtagctgggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggtta

SEQ ID NO: 10915 - DNA, 1397 bp, Homo sapiens
ttctggggagattttaccgagcaacgtagggaaacggctgcctggctacctacccctttttgacacccacacgtgctcggcaccttacatacactgcgtgattttatcctaaagccacttttaaaatcttagtgtgtaaacagagaaactgggcgtcacataaggcaagtgacctgcacagcctgctccggaggagacccgtacgatcccagagacaagcactgaacataaggcacccggcgccgcgcccgctttgcaacctctcgcgacagttgtacgtcatccgagagcgccgtggaagtcgtgctgcaggcgtcgcgccaatcttcgctctgaggtgctgtctcaccggtgagacctggaagcgggcgagtctcgtgctgtgtcggacctgcagcccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggatcttggctcactgcaacctccgcctcccgggcccaagtgatcctcccatctcagcctcctgagtagctgggattacaggcgcacaccaccaatgcccagctagtttttgtgtttttcatagagacagggtctcaccatgtcattcaggttggtcttgaactcctgggctcaagcagtctgcctgccttggcttcccagtgctgggattacaggcgtgagccaccgtgcccggctaaaaagtatttttaagttctgcatattgcttatttcacttaacactatattagagattgttttatatcaatacatatagatatgcttattcttgttgacagttgcataattttccattaaattgatgtatcatgggcagttaaccagttactcgttttactcttagcataactttagggaacaatgtggatgttttgtggttaaagctattaaaacagtggttcttgaccagatgtgtgtttcagaatgttcatctcacatttccagttgctactgatgctgctggtctaggaaccacatatcaaaaccatttggtctccgactaagataaaccctactttatccaattctgtgctcctcttaatatcatatacagataggtttttgttttgtctgtgattaaatgtatcatctaagatactacctactgatcataacgttcatattaaagtattgggtta

SEQ ID NO: 10916 - DNA, 693 bp, Homo sapiens
aatgtagctattatttattgtttgtctttctcctagaaagtaaactttctgagggcaagaatatttttcagttttgtttactactgtattgacagcttggtaggtagtaatcacttaaagttttgttacatgtccgaattaataagaggctgggcagattaactgttcatctgtaccttgaagtattaccagcctttacggaggacaaactagatcctttttgtccacatagtaaatataaacagcaaattgcagaaaagtatgcacagtatgatcttaattgtggcaaattctccttatgaatgtacaaacattcatgcatatctacatgtactgtgtagttaatagtacctttctaaaactgttaacatgggattcatcttggagagatgggggctgaaggaaagttttattttataccattttgtagtgtttgattttttttttttaaccatgggaatgtatttcctatatagcaataaaaaagagtttatttagtcacttctcctcttgcaggactacagaggaaaaaaattaatgttaatcatctgtggtgatgactataaccaaccttatttttcccttgaataatttaactggattttgttctcagatgtaaaggcttggatgaagcatttatcttctgtgtatatgtggtttgtctgatgaatttcttctgcatagtgttaccta

SEQ ID NO: 10917 - DNA, 574 bp, Homo sapiens
aatgtagctattatttattgtttgtctttctcctagaaagtaaactttctgagggcaagaatatttttcagttttgtttactactgtattgacagcttggtaggtagtaatcacttaaagttttgttacatgtccgaattaataagaggctgggcagattaactgttcatctgtaccttgaagtattaccagcctttacggaggacaaactagatcctttttgtccacatagtaaatataaacagcaaattgcagaaaagtatgcacagtatgatcttaattgtggcaaattctccttatgaatgtacaaacattcatgcatatctacatgtactgtgtagttaatagtacctttctaaaactgttaacatgggattcatcttggagagatgggggctgaaggaaagttttattttataccattttttatttgacgttattttccattttttaattttaattttaatttgagacggagttcactctcattgccaagctggagtgaatggcgtgatctcagctcactgagctctgtcagagatgataattcctcttcaaaaagtagtctctgtct

SEQ ID NO: 10918 - DNA, 351 bp, Homo sapiens
ttttctgagtatttttgatccacagttggttaaatctgcaggtgcaaacctgcaaatatgggggaccaactggaaagatacacgtgtaaagatattcattgcagcactgtttgtagggattaaaaatccagaaatggatgcagtatccatgaataaagaaatcactgaatgaattatattcagtgaaatattaggtagctttcaaagagtaagttagacttctatgtattgggagacaggtccctgatatgttgttacttgaaaacaaattatagatttgtgcatggcattttcttaccatttaagcaaaaatcctacacagtcttgtgtcacttaacaatggggacatgt

SEQ ID NO: 10919 - DNA, 796 bp, Homo sapiens
attagctggtttaagggaactgcacacacagcagggagccagattggaccacccccctacaaaccctaaagcgttagctgttagctccggggaagacctcccggcactaagcatggaaaaaggctttcacacccgacttctcttccgtctcctcactgatctaatggattcagcgcggtcactgctcccctcatgaaacttcctaacagtctactctcaccacttttccctctctgacctctgactgtctctcttcagccgtgtcatcacacaccctcccgccagctgcaggggtcctctgaaggtcagccctctgtgctgaggcctgtgcaacatgcagccaccttgtgatttaagctgtcacatctgaatccccagctttggcctctgcctggccacctgaaggacctcaccacggctcaatggtccaaagcagggtcatctttctacaggagtgcctccccttccccactggcccattggtgtcacagctcctgtcaccactctgcaactctttgttctcattcctcactcaacaaatatttgattgcccactatgtgccaaacacaagactagatgtcgaagacaaacataagccaaaccaagacacatctgtcaaaggcatttgagttagatggaaagaaatataaaattacagttgggaaaagtgctacaaaggctggacatggtggctcacgcctgtaatcctaccactttgggaggccaaggctggagggtcagttgagcccaggagttcgagacaaacctgggcaacatagcgagtccctgtctctt

SEQ ID NO: 10920 - DNA, 5418 bp, Homo sapiens
cctcctacccaaagattgatgatgtggaagaagaggggaggagtgcatacacttctgtcaactgctgcccaggatttgattcatgctgaactgaaaatgttgtttacaaaatgctttctgtcctctggctttaaacttggaagaaaaatgatacagaaggagtcagtaagggaagaagtgggaaaccaaaatatagtagagacatccatgatgcaagagccaaattaccagcaagagttaagtaaaccccaaacttggaaggatgtgattggtggatctcagcatagctctcatgaggataccaataaaaatattaactctgagcaggatattgttgaaatggtgtctttagctgctgaggaatcatctttaatgaatgacttatttgcacaagaaattgaatatagtccagttgaattggagtcattgagcaatgaagaaaatattgagacagagagatggaatggaagaatacttcagatgttaaatcgtttacgggtcgctgatcagggccaggcggctgcagcagcgactgcagaggcgctgcgccaagccgggccggagtggtgcgagccggcggggctgcggagggccagtggactcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattccggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcaccctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgaggaccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctaggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagcaaaaaaaaag

SEQ ID NO: 10921 - DNA, 5540 bp, Homo sapiens
ggcggcccctgcagggcagctgaagccatggaagcctccgcaggtcgctgatcagggccaggcggctgcagcagcgactgcagaggcgctgcgccaagccgggccggagtggtgcgagccggcggggctgcggagggccagtggactcagggttgttgagaggagtcaatggcataatacgggaagccccgaaccacgggccaactgggaagttgatggtcggcgagaccagcccatcctaatttggggttcctggtcctgctccaggagtcctacagcctgcagcccctaccagagagggaggactgaacagcaagggggtgtgtgggtctgagtatcagggtcctggggaagaagcaggcctggctcgtagagtagaagactcggtgccggcagtcaggaggccctgctcctgaagcctctgtgaccttgggcacggccttcactctgtctggggcacattcactcatctggagaacacagggttggactgattacttttagccactcctgacagttgtggttttaagttgggtggtgggaacctgtgcaccagccctattcaattcactggtggaggcagccgtggtctgccaggccctcgctcctggggtgtcctgccgaagggtgagaagagaagccatgccgggcagcggccccagcgagaggatgacgtggcctggcccggccctttctgcgggccccccaacccgccctctctcctcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattccggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcaccctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgaggaccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctaggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagcaaaaaaaaag

SEQ ID NO: 10922 - DNA, 3980 bp, Homo sapiens
ccgactggaaagggatgggagtgataccatagggtttggggggcttggcacaacggccctggcctctgcactgtgatagctccaagccaaatggtgcaaggcagctgctgggctgcggggaagaggggctgcacttcctgagctggtgcagcggcagagtggataaggatcaggaccccgagccctcctggccctccaaggcggggggacaccggctgcacccaggctgtgacctcagctgacgccgatgatccacatgggatgcagggtctaattttagctccagccacaggggccacagcccagaagcgtctgccagcgggcacaggggcagccagggctgctcaggcaaggggaggagtgggaagaccagcccagctccctccagcctgtccctggccaagccgcctcctgtgggagctctgactggtccccatggcctggcagacagccctcctctcagttgagggcaaggtcaaggggtgcagccaggagggcagggggacacggccctgcattctggacaggggttgcgtcagccagagcagtgcccaggggcaggggtccctgctgggagggaaaaggctggcttggttgtccaaaggccgagaaggcagagtcctgagagcaggggggccaggccagcaagctgggtcccacctggcctcctcctgcctggctggtgactcactatctgaccttagacaggcggcctggtctcgatgggcctcagtcttcccatctgtacaatgacagcacaggactagcaggtcggtcccagctctggtctcccgccccaggccctgctcttcctgcttgctggcagaggcctcccagcttccctagccctgactgtgggtggccacatgcagtcgtggaggagaagaaagtccctgtggctggcactgtcagcctcctggctcctgcttgtcctgctgggaggcttctcccttctccgcctggcgttgcctcccagacctcggcccggggcttcccaaggctggccccgctggctggatgcagagctcctgcagagcttctcccagcctggagagctcccagaagatgccgtttcacctcctcaagcccctcatggtggcagctgcaactgggaatcttgctttgatacctcaaagtgcaggggcgatggccttaaggtattcgtgtacccagcggttggaaccatctctgagactcatcgcaggatcctggcttccattgagggctctcgcttctacacattcagccctgctggggcctgcctcctcctcctcctcagcctggacgcccagactggagagtgcagctcaatgcctctgcaatggaacaggggcaggaaccatctggtcctccgtctccacccggctccctgccccaggaccttccagctgggacaggctatggtggctgaggccagccccacggtggactccttccggcccggctttgatgtggccctcccttttctccctgaagcccacccgttgcgaggtggggctcctggccagctgcggcaacacagcccccagcccggggtagccctgctagccctggaagaggagaggggtgggtggcgcacagcagacactggctcctctgcctgcccctgggatgggcgctgtgagcaagaccctggacctgggcagacccagcgccaggagacgctgcccaatgccaccttctgcctcatctctggccaccgtcccgaggctgcctcgcgcttcctccaagccctgcaggccggctgcatcccagtgcttctcagcccccgctgggagctgcccttctccgaggtcatcgactggaccaaggcagccatcgtagctgatgagaggctcccacttcaggtcctggctgccctccaggagatgtcccctgcacgggtcctcgccctgcgtcagcagacccagtttctatgggatgcctacttctcctcagtggagaaggtcatccataccactctggaggttattcaggaccggatttttggaacatcagctaacccctcactgctgtggaacagccccccaggggcactcctggccctgtctactttttccacaagcccccaggacttccccttctactacctgcaacagggctcccgccctgagggcagattcagcgccctgatctgggtggggcccccaggccagccccctctgaagctcatccaggcggtggcaggctcccagcactgtgcccagatcttggttctctggagcaatgagaggccactcccatccaggtggccggagacagctgtgcccttgacagtcattgatgggcacaggaaggttagtgatcgcttctacccatatagcaccatcagaacagatgccatcctcagcctcgatgcccgcagcagtctttccacaagtgaggtggactttgcctttctggtgtggcagagcttcccagagcggatggtgggcttcctgacgtcgagccatttctgggacgaggcccatggtggctggggctacactgctgagaggaccaacgaattctccatggttctcaccacagccgccttctaccataggtattaccacactctcttcacccactccctgcccaaggctctgaggaccctggcagatgaggcacccacctgtgtggacgtcctgatgaatttcatagtagcagcagtcaccaagctgccccctatcaaggcgcctgggggcccggggcccaggccaaagccgcctgccccagcccccgactgcatcaaccagatagcggcagcgttcggccacatgcccttgctgtcctctcgtctgcgtctggacccggtgctgtttaaggacccggtgtccgtgcagcgcaagaagtaccgcagcctggagaagccctaggggggcgacccgcggagaccccagcagaggtcgcagcccagctcccagggggcccggcgcctgccggcgggctccgctcttgggacaccggagaacctatcatgtcagccagcgggcccacacgtcggaccccggttggccaatcacaacaggggggcgtggccttaccttctcctgctcgccctcagccgcggagcctctgcggaggctgagccccgcgaccggagcgccgctctccgcttctccacccagctaacttctgctcgtctttcagagcattgtctcctccagggacttgcctggccctcctccccctccgcccccaatgggttcggtctcctttgcgctttcgcagcccagtgtttgccgcggttcccgcacggtcaggccccaggactggcttgcgagccccggggggcgggtcgtgtcgtgtccttttctctctggctaggcaggtgtgccgcaaatatttgacgaatagatggatggcagacattaactgcgtgcctggccctatgagggcggcggcgggacagggtgagcggagagacagaactgtccccgccccaccccgccacccattcctagggttcctagtcccgggaaggcaactacccaaagacgcctgggttgtcaggctcaatccttgagcctcaaccaaggagcagaggggtgcgggtaaacgaggagtggggcgaggaaagcgggatgggaacaagtggcctgtccccgcacggcccgcggctcagcctcggccgtctgccctgcactaccaaggccgaccactagaggtcagcgtcgcgccgcactcttcacccgcatgtccagagggcggccgggatgtggagggtgaacgctgtgggcagctcgggggctgaaagctgggaagagaaatctgaagaacagccccatctctttcgcctgcacacttggaactcagcaagaagggactgtttctaggtgggctgggcgcgagcagggactgtcccgagcggtataggtgagaatggagttggggggggacactaggtctccggggttcacccacctggagctggaattatcacttccgaaataaagcgcgtgtccttgccccctcacgctccaggctataaaaaaaaa

SEQ ID NO: 10923 - DNA, 1991 bp, Homo sapiens
ctagggactaccacagacaactctcttgagttctgaagccacaggtcactaccctcatgtcaccagaatccctgccttctacaagcccagaggcaaggacagagcagcggtgaaaggaccatggatccaactaacccttctcccatgtgcagtttacaaagctgacttctcaaacttcttccaccttgagaaagatcactcctgcccctcgcaacccgccttctgccccagatcccagacttcaagaacaaccccctatcctctagatcttggttctctggagcaatgagaggccactcccatccaggtggccggagacagctgtgcccttgacagtcattgatgggcacaggaaggtggactttgcctttctggtgtggcagagcttcccagagcggatggtgggcttcctgacgtcgagccatttctgggacgaggcccatggtggctggggctacactgctgagaggaccaacgaattctccatggttctcaccacagccgccttctaccataggtattaccacactctcttcacccactccctgcccaaggctctgaggaccctggcagatgaggcacccacctgtgtggacgtcctgatgaatttcatagtagcagcagtcaccaagctgccccctatcaaggtgccctatggcaagcagcgccaggaggctgctccactggcgcctgggggcccggggcccaggccaaagccgcctgccccagcccccgactgcatcaaccagatagcggcagcgttcggccacatgcccttgctgtcctctcgtctgcgtctggacccggtgctgtttaaggacccggtgtccgtgcagcgcaagaagtaccgcagcctggagaagccctaggggggcgacccgcggagaccccagcagaggtcgcagcccagctcccagggggcccggcgcctgccggcgggctccgctcttgggacaccggagaacctatcatgtcagccagcgggcccacacgtcggaccccggttggccaatcacaacaggggggcgtggccttaccttctcctgctcgccctcagccgcggagcctctgcggaggctgagccccgcgaccggagcgccgctctccgcttctccacccagctaacttctgctcgtctttcagagcattgtctcctccagggacttgcctggccctcctccccctccgcccccaatgggttcggtctcctttgcgctttcgcagcccagtgtttgccgcggttcccgcacggtcaggccccaggactggcttgcgagccccggggggcgggtcgtgtcgtgtccttttctctctggctaggcaggtgtgccgcaaatatttgacgaatagatggatggcagacattaactgcgtgcctggccctatgagggcggcggcgggacagggtgagcggagagacagaactgtccccgccccaccccgccacccattcctagggttcctagtcccgggaaggcaactacccaaagacgcctgggttgtcaggctcaatccttgagcctcaaccaaggagcagaggggtgcgggtaaacgaggagtggggcgaggaaagcgggatgggaacaagtggcctgtccccgcacggcccgcggctcagcctcggccgtctgccctgcactaccaaggccgaccactagaggtcagcgtcgcgccgcactcttcacccgcatgtccagagggcggccgggatgtggagggtgaacgctgtgggcagctcgggggctgaaagctgggaagagaaatctgaagaacagccccatctctttcgcctgcacacttggaactcagcaagaagggactgtttctaggtgggctgggcgcgagcagggactgtcccgagcggtataggtgagaatggagttggggggggacactaggtctccggggttcacccacctggagctggaattatcacttccgaaataaagcgcgtgtccttgccccctcacgctccaggctataaaaaaaaa
